United States Patent
Mazzone

(10) Patent No.: US 10,041,126 B2
(45) Date of Patent: Aug. 7, 2018

(54) MONOCYTE BIOMARKERS FOR CANCER DETECTION

(71) Applicants: VIB VZW, Ghent (BE); Life Sciences Research Partners VZW, Leuven (BE); Katholieke Universiteit Leuven, K.U.Leuven R&D, Leuven (BE)

(72) Inventor: Massimiliano Mazzone, Leuven (BE)

(73) Assignees: VIB VZW, Ghent (BE); Life Sciences Research Partners VZW, Leuven (BE); Katholieke Universiteit Leuven, K.U. Leuven R&D, Leuven (BE)

( * ) Notice: Subject to any disclaimer, the term of this patent is extended or adjusted under 35 U.S.C. 154(b) by 11 days.

(21) Appl. No.: 14/374,869

(22) PCT Filed: Jan. 28, 2013

(86) PCT No.: PCT/EP2013/051595
§ 371 (c)(1),
(2) Date: Jul. 25, 2014

(87) PCT Pub. No.: WO2013/110817
PCT Pub. Date: Aug. 1, 2013

(65) Prior Publication Data
US 2015/0017159 A1    Jan. 15, 2015

(30) Foreign Application Priority Data

Jan. 27, 2012    (EP) ..................... 12152916

(51) Int. Cl.
| | | |
|---|---|---|
| *C12Q 1/68* | (2018.01) | |
| *C07K 16/00* | (2006.01) | |
| *G01N 33/574* | (2006.01) | |
| *C12Q 1/6886* | (2018.01) | |

(52) U.S. Cl.
CPC ............ *C12Q 1/6886* (2013.01); *C07K 16/00* (2013.01); *C12Q 2560/00* (2013.01); *C12Q 2600/158* (2013.01); *G01N 33/574* (2013.01)

(58) Field of Classification Search
None
See application file for complete search history.

(56) References Cited

U.S. PATENT DOCUMENTS

| | | | | |
|---|---|---|---|---|
| 5,882,852 | A * | 3/1999 | Bukh ................... | C07K 14/005 435/5 |
| 2006/0029960 | A1 | 2/2006 | Bauer | |
| 2012/0301887 | A1 | 11/2012 | Bankaitis-Davis et al. | |

FOREIGN PATENT DOCUMENTS

| | | |
|---|---|---|
| WO | 2004065632 A1 | 8/2004 |
| WO | 2006017573 A2 | 2/2006 |
| WO | 2010080702 A2 | 7/2010 |
| WO | WO-2010100899 A1 * | 9/2010 ........... C12Q 1/6886 |
| WO | WO-2012121679 A1 * | 9/2012 ........... C07K 16/245 |
| WO | 2013110817 A1 | 8/2013 |

OTHER PUBLICATIONS

HumanHT-12 v4 Expression BeadChip Kit, Illumine, Catalog No. BD103-0204, pub. date and on sale in this country at least before Mar. 14, 2011.*
Stratagene catalog, 1988.*
Lopatina et al., PLos One, Mar. 11, 2011, 6(3): e17899, pp. 1-10.*
DePrimo et al., BMC Cancer, 2003, 3:1-12.*
Martinez et al., J Immunol., 2006, 177:7303-7311.*
Guerra, BioTechniques, 2006, 41(1): 53-56.*
English translation of JP 2012100536(A), pub. date: May 31, 2012.*
Matsunaga et al., Increased B7-H1 and B7-H4 expressions on circulating monocytes and tumor-associated macrophages are involved in immune evasion in patients with gastric cancer, Yonago Acta Medica, 2011, pp. 1-10, vol. 54.
Ugurel et al., Down-regulation of HLA class II and costimulatory CD86/B7-2 on circulating monocytes from melanoma patients, Cancer Immunology Immunotherapy, 2004, pp. 551-559, vol. 53.
Honda et al., Differential expression of mRNA in human monocytes following interaction with human colon cancer cells, Anticancer Research, 2011, pp. 2493-2497, vol. 31.
Pucci et al., A distinguishing gene signature shared by tumor-infiltrating Tie-2-expressing monocytes, blood "resident" monocytes, and embryonic macrophages suggests common functions and developmental relationships, Blood, Jul. 23, 2009, pp. 901-914, vol. 114.
Yokoigawa et al., Overproduction of PGE2 in peripheral blood monocytes of gastrointestinal cancer patients with mucins in their bloodstream, Cancer Letters, 2007, pp. 149-155, vol. 245.
Sugai et al., Characteristic alteration of monocytes with increased intracellular IL-10 and IL-12 in patients with advanced-stage gastric cancer, Journal of Surgical Research, 2004, pp. 277-287, vol. 116.
Sheikh et al., The expression of S100A8 in pancreatic cancer-associated monocytes is associated with the Smad4 status of pancreatic cancer cells, Proteomics, 2007, pp. 1929-1940, vol. 7.
Elkord et al., Human monocyte isolation methods influence cytokine production from in vitro generated dendritic cells, Immunology, 2005, pp. 204-212, vol. 114.
PCT International Search Report, PCT/EP2013/051595, dated Jun. 5, 2013.
Hamm et al., Tumour-educated circulating monocytes are powerful candidate biomarkers for diagnosis and disease follow-up of colorectal cancer, Gut, 2016, pp. 990-1000, vol. 65.
Carey et al., The Primer Extension Assay, 2013, Cold Spring Harb Protoc, doi:10.1101/pdb.prot071902.

* cited by examiner

*Primary Examiner* — Hong Sang
(74) *Attorney, Agent, or Firm* — TraskBritt, P.C.

(57) ABSTRACT

The disclosure relates to the field of biomarkers to diagnose a disease, more particularly to the field of biomarkers to diagnose cancer, and most particularly to colorectal cancer. Specifically, these biomarkers are expressed in monocytes of a subject, particularly circulating monocytes, as can be isolated from peripheral blood. The markers are particularly useful for early detection of cancer.

2 Claims, 29 Drawing Sheets
(28 of 29 Drawing Sheet(s) Filed in Color)

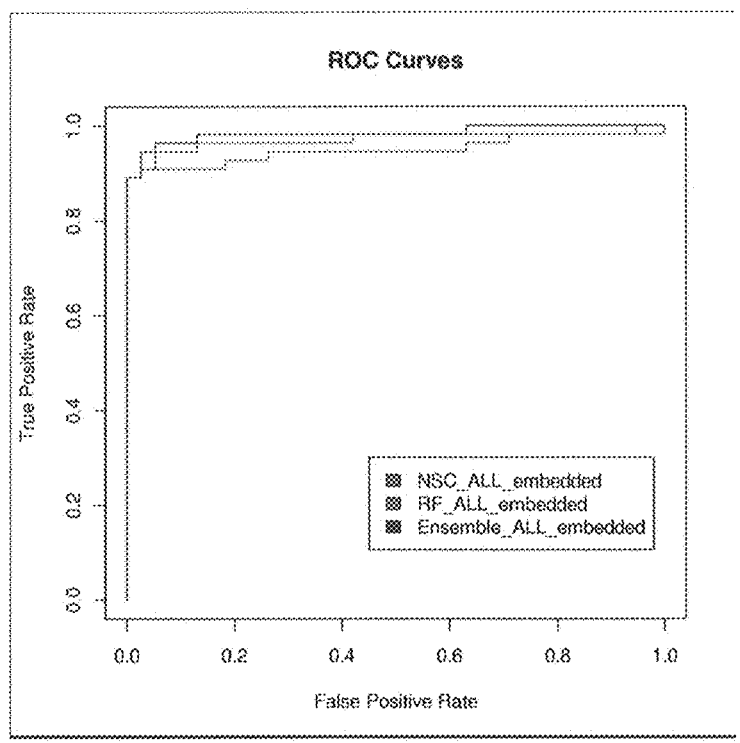
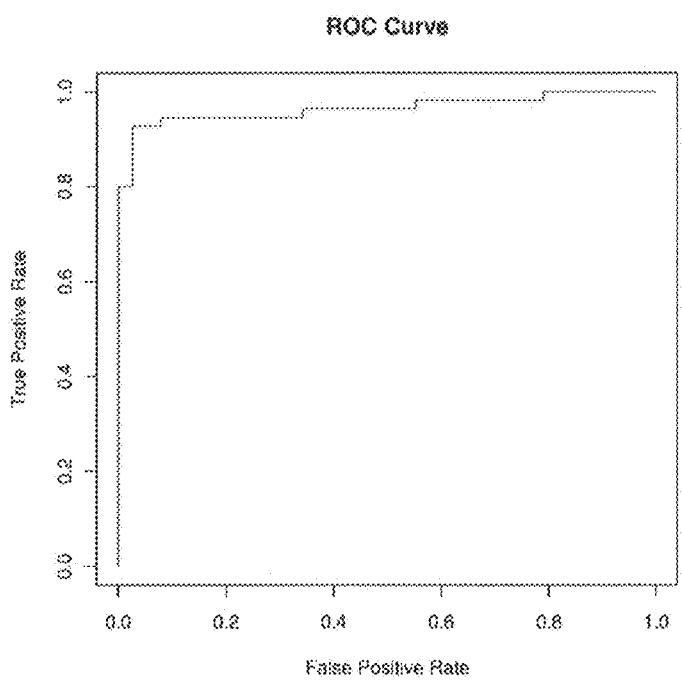
FIG. 1B

MONOCYTE BIOMARKERS FOR CANCER DETECTION

CROSS-REFERENCE TO RELATED APPLICATIONS

This application is a national phase entry under 35 U.S.C. § 371 of International Patent Application PCT/EP2013/051595, filed Jan. 28, 2013, designating the United States of America and published in English as International Patent Publication WO 2013/110817 A1 on Aug. 1, 2013, which claims the benefit under Article 8 of the Patent Cooperation Treaty to European Patent Application Serial No. 12152916.8, filed Jan. 27, 2012, the disclosure of each of which is hereby incorporated herein in its entirety by this reference.

STATEMENT ACCORDING TO 37 C.F.R. § 1.821(c) or (e)—SEQUENCE LISTING SUBMITTED AS PDF FILE WITH A REQUEST TO TRANSFER CRF FROM PARENT APPLICATION

Pursuant to 37 C.F.R. § 1.821(c) or (e), a file containing a PDF version of the Sequence Listing has been submitted concomitant with this application, the contents of which are hereby incorporated by reference. The transmittal documents of this application include a Request to Transfer CRF from the parent application.

TECHNICAL FIELD

The application relates to the field of biomarkers to diagnose a disease, more particularly to the field of biomarkers to diagnose cancer, most particularly colorectal cancer. Specifically, these biomarkers are expressed in monocytes of a subject, particularly circulating monocytes as can be isolated from whole blood. The markers are particularly useful for early detection of cancer.

BACKGROUND

Colorectal cancer (CRC) is the third most common cancer and the fourth cause of cancer-related deaths worldwide. Each year, almost one and a quarter million new cases of colorectal cancer are diagnosed and over six hundred thousand deaths are attributable to this disease (Ferlay et al., 2010). Its incidence and difficult early diagnosis make CRC a primary focus in the oncology community. CRC is often diagnosed after symptoms appear, but most people with early disease are symptomless and symptoms usually appear only with more advanced disease. Therefore, 30 to 40% of CRC patients have metastatic disease at diagnosis (Benson, 2007). The overall survival rate of patients with metastatic colorectal cancer at 5 years is less than 10%. In contrast, up to 80% of patients can be cured by tumor resection if the CRC is detected at an early stage (Benson, 2007). Therefore, early diagnosis is important for the proper control of CRC. Although colonoscopic screening for CRC is currently the most reliable screening tool, the invasive nature and the incurred cost have hampered the wide application of this procedure. On the other hand, the fecal occult blood testing is a non-invasive alternative. However, it lacks the sensitivity and specificity required for an effective screening tool and requires meticulous dietary restriction.

Unfortunately, current therapeutic approaches also lack efficacy to successfully cure the disease, especially in patients with metastatic CRC. Therefore, much effort is needed to optimize the treatment of CRC. In 2004, the U.S. Food and Drug Administration (FDA) approved bevacizumab (AVASTIN®), a humanized monoclonal antibody against vascular endothelial growth factor (VEGF), in combination with classic chemotherapy as a first line treatment for CRC. However, the phase 3 clinical trial revealed that this combination therapy only adds less than 5 months to the overall survival of CRC patients (Hurwitz et al., 2004).

Thus, there is a pressing need to identify specific non-invasive biomarkers for CRC early diagnosis and monitoring, in order to avoid the more advanced stages of the disease that are difficult to cure. Such early, non-invasive biomarkers would in fact be useful for several other tumor types as well.

DISCLOSURE

Provided are biomarkers that are both non-invasive and specific to the disease. Envisaged diseases are different types of cancers, such as (but not limited to) gastric cancer and colorectal cancer, and inflammatory bowel disease (IBD). Most particularly, the biomarkers are biomarkers for colorectal cancer (CRC).

Inflammatory cells such as macrophages and dendritic cells have been suggested as potential (source of) biomarkers in different cancers, as they infiltrate in the tumor tissue. However, they have several drawbacks: due to the dual role of distinct subpopulations of macrophages on tumor growth and progression according to their functional polarization, macrophages have been implicated both in tumor growth and improved survival. Likewise, different status of dendritic cell maturation can correlate with both bad and good prognosis of CRC. Thus, their suitability as marker is unclear. Moreover, since they are in tissue, isolating the markers is an invasive procedure. As they also require the presence of a tumor large enough to isolate them from, they are not suited as early markers.

Thus, it was explored whether precursors of these inflammatory cells could serve as markers. Peripheral blood is one of the less invasive sample sources that can be intensively screened for CRC biomarkers. Blood can for instance be screened for carcinoembryonic antigen (CEA), but this test has a suboptimal sensitivity and specificity. Alternatively, circulating tumor cells can be measured, but this has the drawback of having a low detection rate. It is also not suited for very early detection of cancer. Other blood tests are currently being developed, but often have issues with sensitivity and/or specificity. This is not surprising, given the heterogeneous composition of blood and the opposing functions of its cellular components during cancer progression.

The cellular components of peripheral blood include red blood cells, white blood cells, and platelets. White blood cells, or leukocytes, are cells of the immune system involved in defending the body against both infectious disease and foreign materials. Five different and diverse types of leukocytes exist: neutrophils, basophils, and eosinophils (together the granulocytes or polymorphonuclear leukocytes), lymphocytes and monocytes (together the agranulocytes, mononuclear leukocytes or peripheral blood mononuclear cells (PBMCs)). The three major types of lymphocyte (all from the lymphoid lineage) are T cells and B cells (the major cellular components of the adaptive immune response) and natural killer (NK) cells. Monocytes (from the myeloid lineage) are part of the innate immune system and are able to migrate quickly to a site of inflammation in the body.

Circulating monocytes present in whole blood can give rise to macrophages and dendritic cells. It was investigated whether these monocytes are modified when they are circulating in the blood stream, and whether these cells can be used as diagnostic tools. Surprisingly, it was found that in cancer patients, from a very early stage of the disease, there is a small, yet distinct and reproducible shift in expressed gene signature of circulating monocytes. This is especially surprising, given that circulating monocytes, contrary to tumor-associated macrophages or infiltrated dendritic cells, are not in direct contact with the tumor. Indeed, in circulation they are at a considerable distance from the actual tumor site and they are separated from the tumor by endothelial cells composing tumor blood vessels. This "distant education" thus is different from expression profile changes upon close contact with the tumor, as seen, e.g., in resident macrophages. Without being bound to a particular mechanism, it seems plausible that the observed differences in gene expression of circulating monocytes are caused by factors released by the tumor, such as (but not limited to) cytokines. These differences in monocyte gene expression can be used as biomarkers for cancer, which are both very specific and very sensitive. Importantly, the biomarker(s) can be obtained in a minimally invasive way, as only a small sample of (typically peripheral) blood is required.

Moreover, a subset of genes in this gene signature can be used to discriminate between patients with non-metastatic and metastatic disease. This allows stratification of patients, and may help guide decisions on suitable therapies.

Thus, according to a first aspect, methods are provided of diagnosing a disease in a subject, comprising determining the expression of at least one gene product in a sample of monocytes of said subject. Typically, the methods will be performed in vitro.

It is particularly envisaged that the disease is cancer, particularly a cancer that presents as a solid tumor, more particularly colorectal cancer. The concept of an altered gene signature in monocytes likely is applicable to numerous diseases with an inflammatory component, such as different types of cancer, or such as IBD (inflammatory bowel disease). However, different diseases likely will affect gene expression differently. For instance, it should be realized that the nature of the tumor is bound to influence the factors governing monocyte gene expression, as is shown in the Examples section for colorectal and gastric cancer. The underlying concept, of circulating monocytes whose gene expression profile is altered due to presence of a tumor or disease, is the same however. The signature presented herein is particular for colorectal cancer.

According to further embodiments, the at least one gene product whose expression is deter pined is not a gene product that is used as marker to identify the nature of monocytes in said sample. This in order not to create a bias: if, e.g., CD14 is first used as a marker to isolate monocytes, one has already enriched the population of CD14-expressing cells. This also applies for markers used for subset identification (e.g., Tie2 to isolate Tie2-expressing monocytes). Stated generally, in particular embodiments, any marker that has been used in the isolation procedure prior to determining gene expression of the at least one gene in the sample of monocytes is not envisaged as marker whose expression is determined.

According to further embodiments, the monocytes are circulating monocytes.

According to further embodiments, altered expression of the at least one gene product is indicative of the disease, particularly of cancer; i.e., altered expression of the at least one gene product in a sample of monocytes of a subject is indicative of the presence of a cancer in the subject. Altered expression can be increased or decreased expression. This will depend on the selected genes, as some will be up-regulated while others are down-regulated. Moreover, some genes will show altered expression depending on disease stage, e.g., altered expression between the non-metastatic and metastatic stage of cancer.

If the disease is cancer, it is particularly envisaged that it is colorectal cancer.

For embodiments relating to cancer detection, the monocyte expression profiling described herein is particularly well suited for early detection of cancer. For example, for colon cancer, early detection means that the monocyte expression is already altered (and thus the tumor may be detected) when the tumor is still in Tis stage (i.e., in situ, the tumor only affects the mucosa) or in T1 stage (submucosal infiltration, but not further). This is a particular advantage, since these tumors are routinely missed using other procedures. Without being bound to a particular theory, it is shown herein that the signature (i.e., the altered gene expression is specific to the tumor and not hypoxia-dependent. This may be the reason why smaller, non-hypoxic tumors can be detected using the methods described herein.

According to further embodiments, the at least one gene product comprises at least one product selected from the genes listed in Table I. According to yet further specific embodiments, the at least one gene product comprises at least one product selected from the genes listed in Table II. According to alternative specific embodiments, the at least one gene product comprises at least one product selected from the genes listed in Table IV.

According to specific embodiments, the at least one gene product comprises at least one product selected from the following genes: ACP5, ADM, ALDH1A1, APP, BAX, CD68, CTSZ, CXCR4, DDIT4, DNAJC7, ENSA, FCER1A, FKBP5, GPER, HBA1, HBB, HLA-DQA1, HMOX1, HP, IL1R2, LAPTM4A, LOC644063, LOC723972, RN28S1, S100P, SOCS3, TAF15, TKT, and TNF. Alternatively, or additionally, the selection is made from the list of: ACP5, ADM, ALDH1A1, APP, BAX, CD68, CTSZ, CXCR4, DDIT4, FKBP5, GPER, HBA1, HBB, HP, LAPTM4A, LOC644063, S100P, SEPT5, SLPI, SOCS3, and TKT. More particularly, the at least one gene product comprises at least one product selected from the following genes: ACP5, ADM, ALDH1A1, APP, BAX, CD68, CTSZ, CXCR4, DDIT4, ENSA, FCER1A, FKBP5, GPER, HBA1, HBB, HLA-DQA1, HMOX1, HP, IL1R2, LAPTM4A, LOC644063, S100P, SOCS3, TKT, and TNF. A further particular list from which at least one gene product may be selected is ACP5, ADM, APP, CD68, CTSZ, DDIT4, FKBP5, GPER, HBB, HP, LAPTM4A, S100P, SOCS3, and TKT; or alternatively: ACP5, ADM, APP, CD68, CTSZ, FKBP5, GPER, HBB, HP, LAPTM4A, S100P, SOCS3, and TKT. Yet another particular list from which at least one gene product may be selected is ADM, BAX, CD68, CTSZ, CXCR4, FKBP5, GPER, HBA1, HBB, LAPTM4A, S100P and TKT.

According to further embodiments, the at least one gene product is at least two gene products, more particularly at least three, four or five gene products, or even more particularly, at least six, seven, eight, ten, twelve, sixteen or twenty gene products. According to further embodiments according to this aspect, at least one gene product is from a gene selected from the list of ACP5, ADM, ALDH1A1, APP, BAX, CD68, CTSZ, CXCR4, DDIT4, DNAJC7, ENSA, FCER1A, FKBP5, GPER, HBA1, HBB, HLA-DQA1, HMOX1, HP, IL1R2, LAPTM4A, LOC644063, LOC723972, RN28S1, S100P, SOCS3, TAF15, TKT, and TNF; and at least one other gene product is selected from the genes listed in Table I, Table II, Table III and/or Table IV. Alternatively, at least one gene product is from a gene selected from the list of: ACP5, ADM, ALDH1A1, APP, BAX, CD68, CTSZ, CXCR4, DDIT4, FKBP5, GPER, HBA1, HBB, HP, LAPTM4A, LOC644063, S100P, SEPT5, SLPI, SOCS3, and TKT; and at least one other gene product is selected from the genes listed in Table I, Table II, Table III and/or Table IV.

In particular embodiments, primary cancer can be discriminated from metastatic cancer, using specific marker genes. According to specific embodiments, at least one of the gene products is chosen from ACP5, ADM, ALDH1A1, APP, CD68, ENSA, FKBP5, GPER, HLA-DQA1, LOC644063, LOC723972, RN28S1, S100P, TAF15, TKT and TNF (or alternatively, from ADM, BAX, CD68, CTSZ, CXCR4, FKBP5, GPER, HBA1, HBB, LAPTM4A, S100P and TKT). Note that in these instances, it is particularly envisaged to use more than one marker. For example, at least one marker may be chosen to discriminate between healthy subjects or subjects with disease, while at least one marker is chosen to discriminate between patients with primary cancer or metastasized cancer.

According to specific embodiments, the monocytes have been isolated from a blood sample (e.g., peripheral or central blood sample). It is particularly envisaged that the blood sample is obtained no more than 12 hours, no more than 10 hours, no more than 8 hours, no more than 6 hours, no more than 4 hours or no more than 2 hours prior to starting the isolation of the monocytes from the blood sample.

In a further aspect, methods are provided for diagnosing cancer in a subject, comprising the steps of:
  Isolating, from a blood sample of said subject, a monocyte population;
  Determining in said monocyte population the expression or levels of expression of at least one gene product;
  Correlating the expression of the at least one gene product with the presence or absence of cancer in said subject.

According to further embodiments, the isolating step is done within 12 hours of obtaining the blood sample from the subject. Particularly, however, the isolation of the monocytes is done as soon as possible after drawing the blood from the subject, e.g., within 10 hours, within 8 hours, within 6 hours, within 4 hours, within 2 hours, within 1 hour, or immediately following the blood collection. The isolation of the monocytes should ideally be finished within 12 hours, more particularly within 10 hours, 9 hours, 8 hours, 7 hours, or most particularly within 6 hours of obtaining the blood sample from the subject.

Determining expression or levels of expression may be done using any suitable technique known to the skilled person. When done at the RNA level, suitable techniques include, but are not limited to, RT-PCR (particularly RT-qPCR), hybridization microarray, SAGE (serial analysis of gene expression), RNA-Seq, or the nanostring technology (based on molecular barcoding). According to particular embodiments, the determining of expression levels is done with RT-PCR.

Suitable techniques to determine expression or levels of expression at the protein level include, but are not limited to, antibody-based detection methods such as Western blot, ELISA or FACS. Many of these techniques can also be done using alternatives to classical antibodies, e.g., nanobodies (single domain antibodies, developed by Ablynx), alphabodies (single-chain, triple-stranded coiled coil proteins, developed by Complix) or other protein-binding molecules.

The methods described herein are also particularly useful to monitor evolution of the disease. This is because the gene signature retains plasticity. Monocytes will show an altered gene expression pattern quite rapidly (within hours rather than days) when exposed to an inflammatory stimulus in the body (e.g., the presence of cancer, such as colorectal cancer. This will happen even if the tumor is very small). However, when the stimulus is taken away (e.g., by surgically resecting the tumor), the monocytes will revert their gene expression to baseline values, and vice versa when the stimulus is introduced again.

Thus, according to particular embodiments, the methods provided herein are used for monitoring recurrence of a cancer. In other words, the subject from whom the monocytes are obtained is a subject that had cancer, but in which the cancer has been removed. The methods are then performed to evaluate whether the treatment of the cancer has been successful, or whether the tumor has returned. This is particularly envisaged for monitoring subjects who are at high risk of recurrence (for example, patients who had poorly differentiated tumors or venous or lymphatic invasion).

According to alternative, but not exclusive, particular embodiments, the methods are used for monitoring response to therapy. For example, once the subject has been diagnosed with cancer (using the methods described herein or alternative methods known in the art), and treatment for cancer has initiated, the present methods are performed again over time, to see whether the monocyte gene expression returns to baseline values (i.e., levels comparable to those found in healthy volunteers), as this would be indicative of a successful treatment and eradication of the tumor. It is envisaged that the present methods are particularly suited in determining minimal residual disease (MRD). MRD is the name given to small numbers of cancer cells that remain in the patient during treatment, or after treatment when the patient is in remission (no symptoms or signs of disease). In cancer treatment, MRD testing has several important roles: determining whether treatment has eradicated the cancer or whether traces remain, comparing the efficacy of different treatments, monitoring patient remission status and recurrence of the cancer and choosing the treatment that will best meet those needs (personalization of treatment). Given the fact that even very small tumors are detected with the present gene signature, it is particularly envisaged that the signature presented herein is highly suitable for MRD testing even when the patient has no other symptoms or signs of disease.

As the altered gene expression correlates to the presence of disease and can be used to monitor response to therapy, it is also envisaged that the methods provided herein may comprise an additional step of changing the treatment of the patient based on the results of the diagnosis. For instance, if the patient is receiving a combination of chemotherapeutics, but this does not result in gene expression in the monocytes reverting back to baseline values, this is indicative that the therapy does not work, and a decision may be taken to switch to a different chemotherapy regimen (e.g., different or additional drugs, or a different dose of the same drugs).

According to a further aspect of the disclosure, a gene signature is provided. This gene signature typically comprises at least two genes, wherein at least one gene is selected from the list of ACP5, ADM, ALDH1A1, APP, BAX, CD68, CTSZ, CXCR4, DDIT4, DNAJC7, ENSA, FCER1A, FKBP5, GPER, HBA1, HBB, HLA-DQA1, HMOX1, HP, IL1R2, LAPTM4A, LOC644063, LOC723972, RN28S1, S100P, SOCS3, TAF15, TKT, and TNF; and at least one other gene is selected from the genes listed in Tables I, II, III and/or IV.

According to most specific embodiments, the gene signature is a monocyte gene signature, i.e., a group of genes with altered expression in monocytes, characteristic for a particular condition (particular cancer, most particular colorectal cancer).

The gene signature is particularly useful in the field of medicine. Thus, according to specific embodiments, the gene signature provided herein is provided for use as a medicament. Particularly, it is provided for use as a diagnostic. More particularly, the gene signature provided herein is provided for use in the diagnosis of cancer. Most particularly, the gene signature provided herein is provided for use in the diagnosis of colorectal cancer.

According to a further aspect, kits are provided comprising means to detect the gene signature. For example, kits are provided that contain means to detect expression or levels of expression of at least two genes, wherein at least one gene is selected from the list of ACP5, ADM, ALDH1A1, APP, BAX, CD68, CTSZ, CXCR4, DDIT4, DNAJC7, ENSA, FCER1A, FKBP5, GPER, HBA1, HBB, HLA-DQA1, HMOX1, HP, IL1R2, LAPTM4A, LOC644063, LOC723972, RN28S1, S100P, SOCS3, TAF15, TKT, and TNF; and at least one other gene is selected from the genes listed in Tables I, II, III and/or IV.

It is envisaged that these kits are provided for a particular purpose, such as for diagnosis of cancer, or more particularly, for the diagnosis of colorectal cancer.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

FIGS. 1 A and 1B. ROC curve for several classification approaches to discriminate patient samples (both metastatic and non-metastatic patients, P, PM) from samples obtained from healthy volunteers (HV). FIG. 1B: top, All embedded approaches, bottom, the gene signature from the original Limma analysis as comparison.

FIG. 4A, Left panels show mean expression values and standard error of the mean; right panels show the ROC curve (plot of the sensitivity, or true positive rate, vs.

false positive rate (1–specificity or 1–true negative rate)). Normalization occurred against beta-2-microglobulin (B2M) levels, expression values are shown as copies/10 000 copies of B2M. fly, healthy volunteers. P, PM: combination of patients with a primary tumor (P) and patients with a metastasized tumor (PM). p values in the left panel are calculated by Student's two-sided t-test with Welch's correction for differences between HV and P, PM. p values in right panel are indicated for AUC. FIGS. 4B - 4G, ROC curve for selected genes from a multicenter clinical study, comparing the combined P, PM groups to the HV group. Normalization occurred against beta-2-microglobulin (B2M) levels, expression values are shown as copies/10 000 copies of B2M. Small differences between the ROC curves of FIGS. 4A - 4G are due to the random split in training and test set.

DETAILED DESCRIPTION

Definitions

Figure 1A:
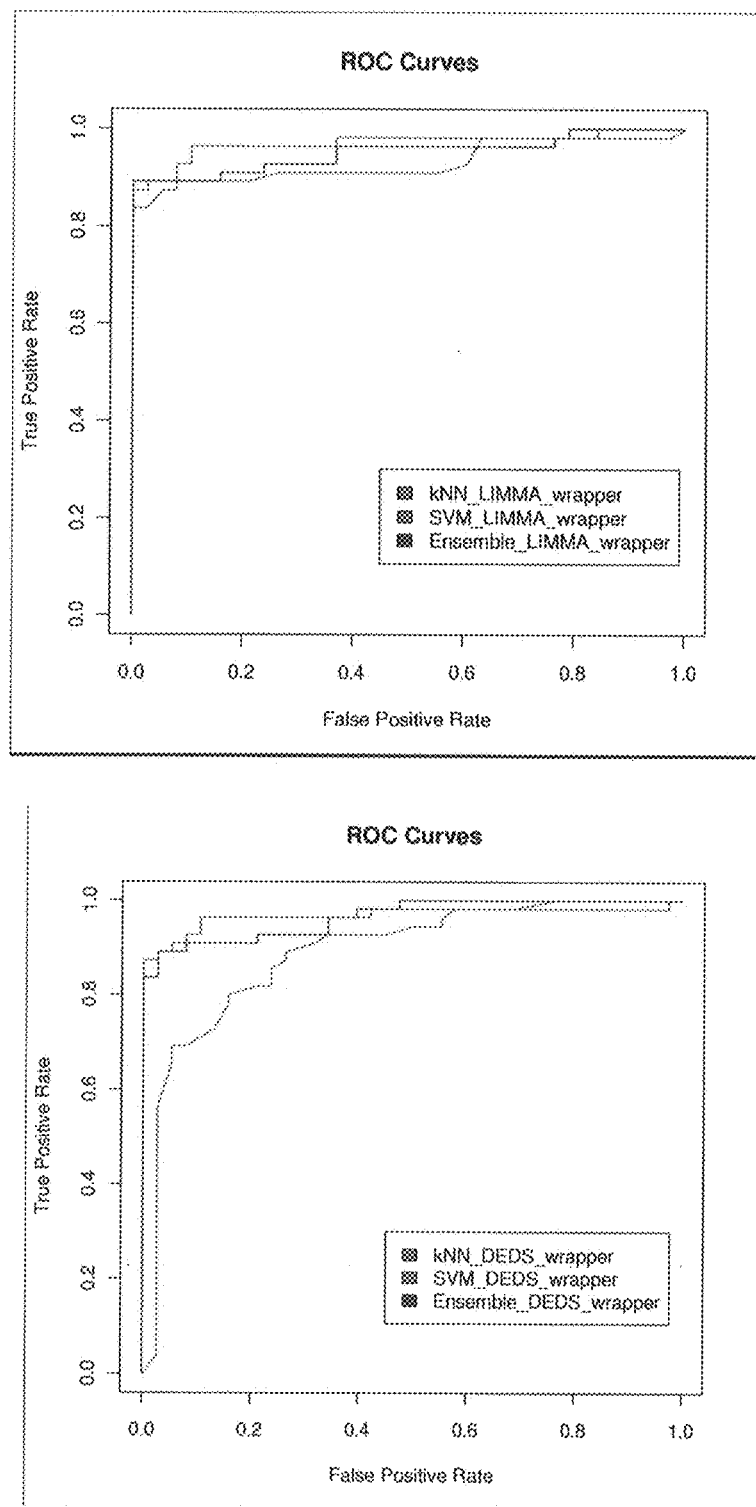
FIG. 1A: top, Limma wrapper approaches, bottom, DEDS wrapper approaches.

The disclosure will be described with respect to particular embodiments and with reference to certain drawings but the disclosure is not limited thereto but only by the claims. Any reference signs in the claims shall not be construed as limiting the scope. The drawings described are only schematic and are non-limiting. In the drawings, the size of some of the elements may be exaggerated and not drawn on scale for illustrative purposes. Where the term "comprising" is used in the description and claims, it does not exclude other elements or steps. Where an indefinite or definite article is used when referring to a singular noun, e.g., "a" or "an," "the," this includes a plural of that noun unless something else is specifically stated.

Furthermore, the terms first, second, third and the like in the description and in the claims, are used for distinguishing between similar elements and not necessarily for describing a sequential or chronological order. It is to be understood that the terms so used are interchangeable under appropriate circumstances and that the embodiments of the disclosure described herein are capable of operation in other sequences than described or illustrated herein.

The following terms or definitions are provided solely to aid in the understanding of the disclosure. Unless specifically defined herein, all terms used herein have the same meaning as they would to one skilled in the art of the disclosure. Practitioners are particularly directed to Sambrook et al., Molecular Cloning: A Laboratory Manual, $3^{rd}$ ed., Cold Spring Harbor Press, Plainsview, N.Y. (2001); and Ausubel et al., Current Protocols in Molecular Biology (updated till Supplement 96), John Wiley & Sons, New York (2011), for definitions and terms of the art. The definitions provided herein should not be construed to have a scope less than understood by a person of ordinary skill in the art.

As used herein, the noun "subject" refers to an individual vertebrate, particularly a jawed vertebrate (i.e., member of the Gnathostomata, which are characterized by a particular adaptive immune system), more particularly an individual mammal, most particularly an individual human being. A "subject" as used herein is typically a human, but can also be a mammal, particularly domestic animals such as cats, dogs, rabbits, guinea pigs, ferrets, rats, mice, and the like, or farm animals like horses, cows, pigs, goat, sheep, llamas, and the like. A subject can also be a non-mammalian vertebrate, like a fish, reptile, amphibian or bird; in essence any animal that has a circulatory blood system wherein monocytes are part of the content of the blood fulfills the definition of subject herein.

"Expression" or "expression of a gene product" as used in the application refers to the process by which inheritable information from a gene, such as the DNA sequence, is made into a functional gene product, such as protein or RNA. This definition thus encompasses, but is not limited to, transcription and/or translation of a gene. "Determining expression" may encompass processes such as detecting or measuring the presence of gene products, or determining the expression levels, i.e., the (relative or absolute) amount of gene product present. Determining expression may be done qualitatively (i.e., whether or not there is expression in a sample) and/or quantitatively (determining the amount of expression, or expression levels). Most typically, expression will be done quantitatively, in order to be able to compare expression levels. Determining expression may involve comparison with a positive control (e.g., to assess whether gene products can be detected in the sample, in particular whether the detection method works), a negative control or a blank (typically to assess whether no false positive signal is being generated), one or more standards (either internal or external standards, typically to allow more accurate quantification), or a combination thereof. The positive control may additionally or alternatively be an internal positive control, typically a gene product known to be present in the sample (e.g., to assess whether gene products can be detected in the sample, in particular whether the detection method works or whether gene products are indeed present in the sample). Detection of expression and/or activity is well known in the art, and a skilled person is capable of choosing appropriate controls and/or standards.

A "gene product" as used herein typically refers to what is transcribed or translated from the gene in question, such as mRNA and protein. The different isoforms or variants of mRNA and the resulting protein isoforms or variants are envisaged within the term gene product. Fragments of a gene product are also envisaged, as long as they are functionally active.

When mRNA is chosen as the (or one of the) gene product whose levels are determined, this can be the total of all mRNA isoforms for the gene(s) under study, or one or more specific mRNAs, e.g., only those expressed in monocytes.

Alternatively or additionally, the gene product of which the levels are determined may be protein. As protein is translated from mRNA and the mRNA exists in multiple isoforms, the same considerations apply: the total protein levels may be determined, or those of specific isoforms only (e.g., using an antibody against the different C-termini). Most particularly, all protein isoforms may be detected (e.g., using an antibody against a common epitope). Of note, it is envisaged as well that both mRNA and protein are determined. In this case, the isoforms to be detected can be all isoforms for both mRNA and protein, identical isoforms (wholly overlapping), or different isoforms (partly or not overlapping), depending on the setup of the experiment. With identical isoforms, it is meant that the mRNA isoform encodes for the corresponding protein isoform. However, for several genes it is known that the number of protein isoforms detected is generally lower than the number of possible mRNA transcripts (and thus of protein isoforms).

Also envisaged is the detection of protein with specific post-translational modifications, either within the whole protein pool or through the selective detection of such modified proteins. Examples of such modified proteins include, but are not limited to, methylated, phosphorylated, ubiquitinylated, glycosylated proteins or any combination thereof.

The term "monocytes" as used herein refers to a particular type of white blood cells that are part of the innate immune system of vertebrates. Monocytes are normally produced by the bone marrow from hematopoietic stem cell precursors called monoblasts. They circulate in the bloodstream for about one to three days and then typically move into tissues throughout the body. Monocytes constitute between three to eight percent of the leukocytes in the blood (reference values in healthy adult humans), and are the largest corpuscle in blood. Once extravasated from the bloodstream to other tissues, they will differentiate into tissue resident macrophages or dendritic cells. The different types of monocytes in human blood can be characterized by expression of CD14 and CD16 cell surface markers: there are $CD14^{hi}$ $CD16^{-/lo}$ monocytes (also termed "classical" monocytes), $CD14^{lo}$ $CD16^{hi/+}$ monocytes ("non-classical monocytes"). Sometimes a third, intermediate category is also distinguished ($CD14^{hi}$ $CD16^{lo}$).

In humans, CD14 is considered a marker of the monocyte lineage. So, at least in humans, "monocytes" can be considered equivalent to CD 14-expressing cells that circulate in the bloodstream (the latter property distinguishing them from dendritic cells and macrophages). Although virtually all CD14-expressing cells in peripheral blood will be monocytes, further differentiation using other markers or cell size can be made to distinguish monocytes from other cell types.

The terms "circulating blood" or "whole blood," which are used as equivalents herein, refer to the blood within the closed cardiovascular system of vertebrates. This comprises the blood in arteries (arterial blood), in veins (venous blood) as well as capillaries, venules and portal systems. Circulating blood cells are the cellular components of blood, consisting of red blood cells, white blood cells, and platelets, which are found within the circulating pool of blood and not sequestered within the lymphatic system, spleen, liver, or bone marrow. The term "whole blood" encompasses both peripheral blood, found in the systemic circulation, and central blood, present in the pulmonary and coronary circulation. The term "circulating monocytes" refers to monocytes that are present in the (peripheral or central) blood and thus part of the circulation (and not migrated into tissue). A "sample of monocytes" as used herein refers to a sample wherein the majority, particularly the large majority, of cells are monocytes. Preferably, the sample consists essentially of monocytes, or it consists exclusively of monocytes. Since only monocytes give rise to macrophages or dendritic cells (the myeloid lineage), and it is desirable that the sample represents this lineage, it is particularly envisaged that the sample contains as little other blood cells as feasible (preferably none). Thus, it is envisaged that no (or virtually none, or as little as feasible) other leukocytes are present in the sample, that no (or virtually none, or as little as feasible) granulocytes are present in the sample, that no (or virtually none, or as little as feasible) other PBMCs are present in the sample, that no (or virtually none, or as little as feasible) lymphocytes (T cells, B cells, NK cells) are present in the sample. According to particular embodiments, the sample does not consist of a mixed monocyte-lymphocyte population. In other words, the sample is not a population of peripheral blood mononuclear cells. According to alternative embodiments, the sample does not contain lymphocytes. Thus, a sample of monocytes can be interpreted as a sample of isolated monocytes. In other words, although circulating blood contains monocytes, according to particular embodiments, it does not fulfill the definition of a sample of monocytes. To obtain a sample of monocytes from a blood sample, a further separation or isolation step is needed. Typically, this is done by density gradient separation (to isolate the PBMNC from the rest of the blood constituents) followed by marker-assisted separation; but a one-step isolation procedure (by marker(s) only) can be applied as well.

For example, in humans, one can separate the CD14-expressing cells in peripheral blood from the non-CD 14-expressing cells to obtain a sample of monocytes as envisaged herein. Although monocytes can be further divided in subpopulations, for instance depending on expression of particular receptors (e.g., but not limited to, CD16), it is primarily envisaged herein to use a sample of all subtypes of monocytes found in the peripheral blood. According to alternative embodiments, gene expression can be determined in particular subsets of monocytes (e.g., CD16-expressing monocytes, Tie-2 expressing monocytes, CCR2-expressing monocytes, etc.). However, according to very specific embodiments, the methods presented herein are not practiced on a sample consisting essentially of a subset of Tie2-expressing monocytes.

Further, since the present gene signature is particularly envisaged for making a diagnosis, it is particularly foreseen that freshly isolated monocytes are used. With "freshly isolated" it is meant that the monocytes have not been kept in culture, since this would influence gene expression as well as other properties (Hart et al., 1995; see Example section as well). Importantly, it does not necessarily imply that the monocytes have been isolated immediately prior to determining the gene expression, as it is possible (and often more practical) to isolate the monocytes beforehand, store them (e.g., by lysing them and freezing them) and determine gene expression at a later point in time. Thus, according to particular embodiments, the sample of monocytes does not consist of cultured monocytes (or a culture of monocyte cells).

As is evident from the previous paragraphs, the sample of monocytes may be provided as such, or may be pre-processed. Examples of pre-processing include, e.g., lysis or additional separation or purification steps.

As used herein, "altered levels" of a gene product may mean either "increased levels" or "decreased levels" of a gene product, which is typically assessed versus a control. The skilled person is capable of picking the most relevant control. This may for instance depend on the particular gene product, the nature of the disease or cancer studied, the sample(s) that is/are available, and so on. Suitable controls include, but are not limited to, expression in a sample of monocytes of a subject that is cancer-free (optionally from the same subject when he/she was still healthy), a monocyte sample from a subject with a non-metastasizing tumor (particularly with the same tumor type as the subject, e.g., colorectal cancer), or a set of clinical data on average monocyte gene product levels in healthy volunteers or patients with non-metastasizing tumors. It may also be an artificially generated expression standard, e.g., as used in "real" quantitative PCR. As is evident from the foregoing, the control may be from the same subject, or from one or more different subjects or derived from clinical data. Optionally, the control is matched for, e.g., sex, age, etc.

With "increased" levels of a gene product as mentioned herein, it is meant levels that are higher than are normally present. Typically, this can be assessed by comparing to control. According to particular embodiments, increased levels of a gene product are levels that are 10%, 20%, 25%, 30%, 40%, 50%, 60%, 70%, 75%, 80%, 90%, 100%, 150%, 200% or even more higher than those of the control. According to further particular embodiments, it means that the gene product is present, whereas it normally (or in control) is not expressed, or is expressed at very low or barely detectable levels. In other words, in these embodiments detecting the presence of a particular gene product is equivalent to detecting increased levels of the gene product.

According to yet further particular embodiments, it means that the gene product is present, whereas in the majority of monocyte samples from tumor-free individuals, taken as a control, it is not. The skilled person will appreciate that the exact levels by which a gene product needs to be higher in order to allow a reliable and reproducible diagnosis may depend on the type of tumor tested, of which product (mRNA, protein) the levels are assessed and the natural variability of these levels. However, assessing the increase itself is fairly straightforward, since it only requires routine techniques.

Instead of looking at increased levels compared to a negative control, the skilled person will appreciate that the reverse, comparing to a positive control, can also be done. Thus, if the gene product levels measured in the monocyte sample are similar to those of a "control" obtained from a subject with a tumor, or with a metastasizing tumor (or are, e.g., comparable to monocyte gene product levels found in a clinical data set of tumors or metastasizing tumors), this may be considered equivalent to increased gene product levels compared to a negative control, and be correlated to presence of disease, or progression to metastasis. In the other case, if gene product levels are significantly lower than those of a positive control, this can be used to establish the absence of a metastasizing tumor, or even the absence of a tumor as such.

For "decreased levels" of a gene product compared to a positive control, the considerations about increased levels of a gene product apply mutatis mutandis. Of course, gene product levels may be compared to both a negative and a positive control in order to increase accuracy of the diagnosis.

Note that, when both increase in levels of a gene product and decrease in levels of another gene product are determined, the levels of one gene product can be divided by the levels of the other gene product. When comparing the resulting value to that of a division of the appropriate control or standard values, the potential difference will be enlarged when both genes have an altered expression, thereby enlarging the window for detection.

The term "cancer" as used herein, refers to different diseases involving unregulated cell growth, also referred to as malignant neoplasm. The term "tumor" is used as a synonym in the application. It is envisaged that this term covers all solid tumor types (carcinoma, sarcoma, and blastoma). According to particular embodiments, the cancer is not a liquid tumor (blood cancer). According to specific embodiments, the cancer is not leukemia, not lymphoma and/or not myeloma. The term "colorectal cancer" as used herein is meant to include malignant neoplasms of colon (C18 in ICD-10), malignant neoplasms of rectosigmoid junction (C19 in ICD-10), malignant neoplasms of rectum (C20 in ICD-10) and malignant neoplasms of anus and anal canal (C21 in ICD-10).

"Early detection" of disease refers to establishing the presence of a disease before it has fully developed. Many diseases are classified in grades, stages or classes to describe the different phases of a disease. For example, for cancer, cancer stages can be classified using the TNM system or Roman numeral staging according to UICC or AJCC, respectively. In the TNM systems, detection of tumors that are in situ ("Tis") or are sufficiently small (typically in the magnitude of 1 cm, although this depends on tumor type and affected organ) and extend minimally to other tissues ("T1") whilst they have not spread to lymph nodes ("N0") and are not metastasized ("M0") can be considered as early detection. In the Roman numeral staging, this corresponds to detection of Stage 0 or Stage I tumors. Other classifications exist, often depending on tumor type (e.g., Dukes staging for colon cancer, CIN grading for cervical cancer, etc.). The skilled person will be aware of the features for each tumor type that are typical for early stages, and of the stages in other systems that correspond to Tis, T1, Stage 0 or Stage I tumors.

A "gene signature" as used herein refers to a group of genes in a type of cell whose combined expression pattern is uniquely characteristic of a medical or other condition. Typically, a group of genes refers to at least two genes, but this may also be at least three genes, at least four genes, at least five genes, at least six genes, at least seven genes, or at least eight genes. Sometimes, it may even be at least more than eight genes (e.g., 10 genes, 12 genes, 16 genes, 20 genes, etc.). According to particular embodiments, the gene signature is a monocyte gene signature, i.e., a gene signature in monocytes. According to particular embodiments, the gene signature is characteristic of cancer, particularly of colorectal cancer.

Peripheral blood is one of the less invasive sample sources that can be intensively screened for CRC biomarkers. Peripheral blood monocytes (PBM) represent a reservoir of inflammatory cells that contribute to disease progression by different means (Murdoch et al., 2008). When recruited into tumors from the circulation, the microenvironment can drive monocyte differentiation into either macrophages or dendritic cells. Tumor-associated macrophages (TAMs) are typically characterized as either "classically" activated tumoricidal and anti-angiogenic macrophages (termed M1) or "alternatively" activated pro-tumorigenic and pro-angiogenic macrophages (termed M2). Monocyte-derived dendritic cells (DCs) are professional antigen-presenting cells that raise the immune response against the tumor. However, the tumor restricts the development of fully competent mature DCs. As a consequence, immature DCs display low immune-stimulatory capacity and induce immune-tolerance. In CRC, the contribution of TAMs to the progression of the disease is controversial as high numbers of infiltrating tumor associated macrophages have been associated with both tumor growth (Sickert et al., 2005) and improved disease-free survival (Forssell et al., 2007). The different outcomes may be explained by the dual role of distinct subpopulations of macrophages on tumor growth and progression according to their functional polarization (Lewis and Pollard, 2006; Allavena et al., 2008). Similarly, different status of dendritic cell maturation can correlate with both bad and good prognosis of CRC patients (Sandel et al., 2005). However, it remains unknown in the art whether PBM, cell precursors of TAMs and DCs, are modified by tumor released cytokines when they are circulating in the blood stream, and whether these cells can be thus used as diagnostic tools.

As detailed herein, it is surprisingly shown that circulating monocytes indeed show an altered gene expression pattern from the very earliest stages of the presence of disease, such as presence of a tumor. It is particularly envisaged that the disease is an inflammatory disease or disease with an inflammatory component, given the roles of monocytes in the inflammation process. Examples of inflammatory diseases include, but are not limited to: atherosclerosis, acne vulgaris, allergies, asthma, autoimmune diseases, cancer, celiac disease, chronic prostatitis, glomerulonephritis, hypersensitivities, inflammatory bowel diseases, ischemic heart disease, pelvic inflammatory disease, reperfusion injury, rheumatoid arthritis, sarcoidosis, transplant rejection, vasculitis, and interstitial cystitis. In principle, for each of these inflammatory diseases a monocyte gene signature can be derived, comprising at least one gene differentially regulated in monocytes.

A most particular envisaged inflammatory disease is cancer. A most particularly envisaged form of cancer is colorectal cancer. Thus, methods of diagnosing diseases such as cancer in a subject are provided, comprising determining the expression of at least one gene product in a sample of monocytes of said subject.

The skilled person is well aware of different methodologies that can be used to determine expression of at least one gene product, in particular, for quantitative measuring of the gene product.

When the gene product is mRNA, for instance, levels of mRNA can be quantitatively measured by Northern blotting, which gives size and sequence information about the mRNA molecules.

A more modern approach for measuring mRNA abundance is reverse transcription quantitative polymerase chain reaction (RT-PCR followed with qPCR). RT-PCR first generates a DNA template from the mRNA by reverse transcription, which is called cDNA. This cDNA template is then used for qPCR where the change in fluorescence of a probe changes as the DNA amplification process progresses. With a carefully constructed standard curve qPCR can produce an absolute measurement such as number of copies of mRNA, typically in units of copies per nanoliter of homogenized tissue or copies per cell, or normalized as copies per specified number of copies for a housekeeping gene. Examples of housekeeping genes include, but are not limited to, actin and B2M. Although there may be slight (particularly quantitative) shifts when one uses normalization with one particular housekeeping gene over the other, the overall conclusion of (qualitative) up-regulation or down-regulation will not be affected. Any suitable housekeeping gene known to the skilled person is envisaged herein for use in normalization. It is also envisaged that normalization is done with more than one housekeeping gene, e.g., to check or improve robustness of results. qPCR has the advantage of being very sensitive (detection of a single mRNA molecule is possible).

If, rather than determining expression of one or a few genes, expression levels of multiple genes are simultaneously determined, DNA microarrays are a suitable technique. Using DNA microarrays, transcript levels for many genes at once (expression profiling) can be measured. Recent advances in microarray technology even allow for the quantification, on a single array, of transcript levels for every known gene in several organism's genomes, including humans.

An alternative way of measuring mRNA abundance makes use of "tag based" technologies. An example includes SAGE (serial analysis of gene expression), which extracts small chunks of sequences from mRNA molecules, links these into concatemers and sequences these.

Another alternative is RNAseq, also known as whole transcriptome shotgun sequencing, which uses high-throughput next-generation sequencing technologies to sequence cDNA in order to analyze a sample's RNA content. Examples of next-generation sequencing include, e.g., pyrosequencing (such as 454/Roche), polymerase-based sequence-by-synthesis (such as offered by Illumina), ligation-based sequencing (such as offered by SOLiD).

Another possible approach is commercialized by NanoString Technologies. Single mRNA molecules are individually tagged with fluorescent barcodes ("nanostrings"), which can be detected one-by-one and counted for direct digital quantification. The advantage of this approach is that it does not rely on analog quantification of fluorescent intensity, which can be problematic due to noise, lack of linearity, and narrow dynamic range. Instead, the technique relies on fluorescence to detect simply the presence of a single mRNA molecule in a binary ("yes" or "no") mode. No amplification is necessary, and detection can often be done without much pre-processing of the sample.

Of course, many more platforms is exist, and the disclosure is not limited to a particular methodology. Other examples of technology that could be used for data gathering or analysis include, e.g., the Dynamic Multi-Analyte Technology ("DMAT") platform of BIOCARTIS®, or qbaseplus (Biogazelle) for automated and improved analysis.

When the gene product to be determined is/are proteins, the expression level can be directly assessed by a number of means with some clear analogies to the techniques for mRNA quantification. Examples include Western blot, ELISA, FACS, two dimensional electrophoresis, mass spectrometry-based methods, isotope-coded affinity-tag-based protein profiling (ICAT), multidimensional protein identification technology (MudPit), peptide arrays, and the like. According to particular embodiments, the signature measures expression of membrane-expressed biomarkers, so that, e.g., FACS can be used to sort and/or determine expression levels.

This list provides a few exemplary technologies, but is by no means exhaustive. The skilled person will be aware of other methods to determine mRNA or protein levels, and these methods are envisaged as well. The nature of the method is not vital to the disclosure, as long as expression of a gene product can be determined.

The methods presented herein involve determining expression of at least one gene product in a sample of monocytes. The expression of this gene product can then be correlated to presence of a disease, i.e., the at least one gene product serves as a marker. Whereas it is possible to use one gene product as marker for a disease, it is, of course, also envisaged to use more than a single marker to make the diagnosis more robust; e.g., a selection of 2 markers may be used, of 3 markers, of 4 markers, 5 markers, 6 markers, 7 markers, 8 markers, 9 markers, or of 10 or even more. For instance, part or the full 29 marker list of Table III can be used as marker panel (i.e., a selection from the following list of genes: ACP5, ADM, ALDH1A1, APP, BAX, CD68, CTSZ, CXCR4, DDIT4, DNAJC7, ENSA, FCER1A, FKBP5, GPER, HBA1, HBB, HLA-DQA1, HMOX1, HP, IL1R2, LAPTM4A, LOC644063, LOC723972, RN28S1, S100P, SOCS3, TAF15, TKT, and TNF. More particularly, a selection from the genes: ACP5, ADM, ALDH1A1, APP, BAX, CD68, CTSZ, CXCR4, DDIT4, ENSA, FCER1A, FKBP5, GPER, HBA1, HBB, HLA-DQA1, HMOX1, HP, IL1R2, LAPTM4A, LOC644063, S100P, SOCS3, TKT, and TNF.). Even more particularly, a selection is made from the genes: ACP5, ADM, ALDH1A1, APP, CD68, CTSZ, DDIT4, FKBP5, GPER, HBB, HP, LAPTM4A, S100P, SOCS3, TAF15 and TKT; even more particularly, a selection is made from the genes: ACP5, ADM, ALDH1A1, APP, CD68, CTSZ, FKBP5, GPER, HBB, HP, LAPTM4A, S100P, SOCS3, TAF15 and TKT. Alternatively, part or the full 43 marker list of Table IV can be used as marker panel. Examples of subsets there include, but are not limited to, a selection from the list of: ACP5, ADM, ALDH1A1, APP, BAX, CD68, CTSZ, CXCR4, DDIT4, FKBP5, GPER, HBA1, HBB, HP, LAPTM4A, LOC644063, S100P, SEPT5, SLPI, SOCS3, and TKT. More particularly, a selection of the list of: ADM, APP, BAX, CD68, CTSZ, CXCR4, FKBP5, GPER, HBA1, HBB, LAPTM4A, S100P, SEPT5 and TKT.

Genes are indicated herein using their official symbols, as provided by the HUGO Gene Nomenclature Committee (HGNC).

Alternatively, part or the full 45 marker list of Table II can be used as marker panel, part or the full marker list of Table IV, or even part or the full marker list of the 336 probes (genes listed in Table I). These markers are particularly useful for diagnosing the presence and/or the stage of colon cancer. Including extra markers may increase robustness and/or reliability of the diagnosis, or may offer extra information regarding disease progression or stage. The number of markers can in principle be increased ad libitum, although this may be limited for practical reasons (cost, methodology, no more increase in information, etc.).

According to some specific embodiments, it may be useful to exclude particular markers. Most particularly, the at least one gene product whose expression is determined is not a gene product that is used as marker to identify the nature of monocytes in said sample. It can indeed be foreseen that if a marker is used for monocyte isolation, this marker will automatically be enriched in the isolated cells. Thus, increased expression of such marker is not a change that depends on presence of disease, but may be an artifact of the isolation procedure. Therefore, the marker(s) for diagnosing disease are preferably different from that/those used in obtaining or isolating the monocyte population.

Accordingly, as envisaged in these embodiments, the at least one gene product whose expression is determined in the sample or population of monocytes is not a gene product that was used to characterize, isolate or separate the monocytes. Thus, if CD14 was used to establish the monocyte nature of the cells, the at least one gene product whose expression is determined is not a product of the CD14 gene. Likewise, if expression of an additional subset marker, e.g., Tie-2, is used to determine the subpopulation of monocytes, then this additional marker is not a marker whose expression is used to diagnose presence, absence or status of disease. In general terms, particular monocyte markers or monocyte differentiation markers are excluded as markers to determine disease status.

Typically, expression of the at least one gene is altered in the monocytes of a subject with the disease as compared to a healthy control. The altered expression levels of the at least one gene product are then indicative of the disease. Altered gene expression levels may be increased or decreased expression levels, and the increase or decrease in expression levels is then indicative of disease. To increase the detection window, the level of genes that are increased can be divided by the level of genes that are decreased (or vice versa), as this will amplify the difference when expression is altered without affecting the result of this division when gene levels are not both altered in the respective direction. Moreover, whereas a first category of markers presented herein are suited to discriminate between healthy and disease status, a second category of markers is useful to characterize disease severity (i.e., grade the disease). Note that these categories are not mutually exclusive: a marker may be useful both for discriminating between healthy and disease state and for determining disease severity. This is because the expression of marker genes does not necessarily remain stable over time. Indeed, marker genes whose expression is up-regulated in monocytes upon presence of a disease either may retain their increased expression, may further be increased upon progression of the disease, or expression levels may be down-regulated upon disease progression (in the latter case, they may be down-regulated but expression levels are still higher than those found in healthy individuals, they may be down-regulated to the levels found in healthy subjects, or expression levels may be down-regulated to levels that are lower than those found in healthy controls). Depending on the statistical relevance of the expression change (compared to healthy control or, e.g., compared to early stages of disease), the skilled person can decide for which change he uses the markers. The same applies, mutatis mutandis, for marker genes whose expression is down-regulated upon presence of a disease.

A typical example of disease progression can be found in cancer, where in early stages the cancer is present only as a solid tumor, while in later stages the tumor has metastasized. Markers indicative of progression will then be able to distinguish the metastasized state.

By way of non-limiting examples, for colon cancer, expression of DDIT4 or CXCR4 in monocytes is a very relevant marker to discriminate between healthy individuals and patients with cancer, but the marker is less suited to discriminate between people with or without metastasis. FKBP5 and GPER expression levels can be used as a marker to discriminate between healthy people, people with only solid tumors, and subjects with metastasized colon cancer. ENSA expression levels can be used to discriminate patients with a solid tumor from healthy controls as its expression levels are initially increased. In patients with metastasized tumors, the expression levels decrease again (cf. FIGS. 2A-2O). Thus, if it is known that cancer is present (e.g., by using another marker presented herein), the lower ENSA levels will indicate that the cancer is in an advanced state, as the decrease of ENSA expression compared to patients with a non-metastasized tumor is statistically significant. In other words, if ENSA levels are not significantly changed compared to a healthy control, it is envisaged to determine expression of at least one other marker to be able to derive the presence of the disease; ENSA can then be used as a marker to classify the disease stage. The same applies for other markers where the expression difference with healthy controls is only present in either early or advanced disease stage, but not in the other stage.

The use of particular genes for determining stage of a disease will be discussed in more detail in the Examples section.

A non-limiting selection of genes that are particularly suited to determine presence of disease (i.e., expression of these genes in monocytes in both early and late disease stages is significantly different from expression in monocytes from healthy controls) include: ACP5, ADM, CXCR4, DDIT4, DNAJC7, FCER1A, FKBP5, GPER, HBA1, HBB, HLA-DQA1, HMOX1, HP, IL1R2, LAPTM4A, LOC644063, LOC723972, RN28S1, S100P, SOCS3 and TKT. According to alternative embodiments, the genes that are particularly suited to determine presence of disease are one or more selected from ACP5, ADM, ALDH1A1, APP, BAX, CD68, CTSZ, CXCR4, DDIT4, FKBP5, GPER, HBA1, HBB, HP, LAPTM4A, LOC644063, S100P, SEPT5, SLPI, SOCS3, and TKT, as these are all genes that combine good AUC values with good p values in ROC curves comparing combined P, PM groups with the HV group. Other particular subsets include one or more genes selected from the group of: ACP5, ADM, APP, BAX, CD68, CTSZ, CXCR4, DDIT4, FKBP5, GPER, HBA1, HBB, HP, LAPTM4A, S100P, SLPI, SOCS3, TKT, ALDH1A1, and SEPT5. Alternatively, one or more genes selected from the group of: ADM, APP, BAX, CD68, CTSZ, CXCR4, FKBP5, GPER, HBA1, HBB, LAPTM4A, S100P, SEPT5 and TKT.

Yet another alternative is one or more genes selected from the list of: ADM, BAX, CD68, CTSZ, CXCR4, FKBP5, GPER, HBA1, HBB, LAPTM4A, S100P, and TKT.

Selected genes that are particularly suited to discriminate between non-metastasized and metastasized cancer include, but are not limited to: ACP5, ADM, ALDH1A1, APP, ENSA, FKBP5, GPER, HLA-DQA1, LOC644063, LOC723972, RN28S1, S100P, TAF15, TKT and TNF. Most particularly envisaged are markers selected from the list of: ACP5, ALDH1A1, ENSA, LOC644063, LOC723972, TAF15, TKT and TNF; as these markers have a very low p value when comparing expression values in monocytes from patients with non-metastasized versus metastasized tumors. Another selection of genes that are particularly suited for discriminating between non-metastasized and metastasized cancer are markers selected from the list of: ALDH1A1, BAX, LOC644063 and TNF. Most particularly envisaged is the use of ALDH1A1.

A selection of genes that are particularly sensitive and specific markers (i.e., have a high area under curve for a ROC curve) for colon cancer (and are thus particularly suited as single markers) include, but are not limited to: ADM, CXCR4, DDIT4, DNAJC7, FCER1A, FKBP5, GPER, HBA1, HBB, HLA-DQA1, IL1R2, RN28S1, S100P, SOCS3 and TKT. An alternative selection is one or more genes selected from the list of: ADM, BAX, CD68, CTSZ, CXCR4, FKBP5, GPER, HBA1, HBB, LAPTM4A, S100P, and TKT.

The methods as described herein determine gene expression in a sample of monocytes. This sample of monocytes typically has been obtained from a subject at some time prior to determining the gene expression. As monocytes circulate in the blood, normally a blood sample will be taken from the subject from which sample the monocytes can be isolated. Typically, peripheral blood will be used, as this is the easiest to obtain: it is readily accessible and the procedure is minimally invasive. According to particular embodiments, however, central blood can be used for the blood sample from which the monocytes are isolated, e.g., obtained using a central venous catheter. This may be interesting for patients who are already hospitalized and have such a catheter.

Once a blood sample has been procured, the monocyte sample can be obtained by isolating the monocyte population from the rest of the constituents in the blood. There are many possible methods to isolate the monocyte fraction from a total blood sample, and the nature of the isolation is not vital to the disclosure, as long as it results in a relatively pure population of monocytes (i.e., essentially consisting of monocytes, not other cells). By way of non-limiting example: typically, first peripheral blood mononuclear cells (PBMNCs) are separated from the rest of the blood. This can be done for instance by density gradient centrifugation (e.g., using LYMPHOPREP® from Axis-Shield, FICOLL-PAQUE™ PLUS from GE Healthcare; ACCUSPIN™ System HISTOPAQUE®-1077 from Sigma-Aldrich). Monocytes can be isolated from the PBMC fraction by using marker-assisted selection, e.g., using a MACS system (Miltenyi Biotech, Bergisch Gladbach, Germany) following the manufacturer's protocol, or alternatively by FACS. Typical markers for monocyte selection include CD14, CD16, Slan (6-Sulfo LacNAc). Note that negative selection is also possible, by labeling the non-monocytes (i.e., T cells, NK cells, B cells, dendritic cells and basophils) in the sample using for instance a selection of antibodies against CD3, CD7, CD15, CD16, CD19, CD56, CD123 and Glycophorin A (e.g., using the monocyte isolation kit II from Miltenyi Biotech, Bergisch Gladbach, Germany). Alternatively, monocytes can be isolated using a plastic adherence protocol, as, e.g., described in Elkord et al., 2005.

A one-step isolation process to obtain monocytes from whole blood can, e.g., be envisaged by using a CD14 antibody, e.g., by coating a plate with CD14 antibody, incubating the plate with whole blood, washing the blood away, whereupon the remaining fraction in the dish will be the monocyte fraction.

Although it is not the most preferred option, it is envisaged that the gene signature can be derived from blood directly. According to these very specific embodiments, the at least one gene of which the expression is determined is present only in monocytes, or the change in expression is much bigger in monocytes than in other blood cells. If that is the case, determining the expression in blood cells will reflect the altered expression in monocytes (i.e., the other cells do not interfere with the expression determining step), and only in that case can the blood sample be regarded as equivalent to a sample of monocytes. As it can be envisaged that gene expression is altered in lymphocytes and granulocytes as well (due to different factors, e.g., a common cold has a high influence on the level of granulocytes), such set-up should be carefully evaluated, as it is not expected to work for all genes in all circumstances. However, in such instances where monocyte extraction from blood is not readily feasible, this can be considered an alternative.

As expression of gene products is a dynamic process, it is important to start the isolation of the monocytes from the blood sample within a timeframe where expression levels are not altered again, in order not to obtain false positive or negative results. In other words, freshly isolated blood should be used for isolation of the monocytes, and the blood should be stored appropriately (2-8° C.) before isolation is started. Particularly, monocyte isolation is started within 6 hours of obtaining the blood sample from the subject, more particularly, the monocyte isolation is started within 5 hours, 4 hours or 3 hours of obtaining the blood sample, most particularly, the monocyte isolation is started within 2 hours, 1 hour, 45 minutes, half an hour, 15 minutes, or immediately after the obtaining of the blood sample. Ideally, the monocyte isolation procedure does not take too long, e.g., not more than 4 hours, 3 hours or 2 hours. Accordingly, the monocyte isolation procedure is finished (=the monocyte population is isolated) within 10 hours of obtaining the blood sample from the subject, more particularly within 9 hours, 8 hours, 7 hours or most particularly within 6 hours, 5 hours or less after obtaining the blood sample.

Once the monocytes have been isolated from the blood, expression of at least one gene product of the monocytes can be determined. This can be done immediately after the isolation of the monocytes. However, it is envisaged that the monocytes are thus prepared that they can be used at a later point in time, e.g., by lysing the monocytes in an RNA lysis buffer (e.g., Buffer RLT, Qiagen) and storing the lysate at −80° C. (or lower) for up to 1 year. Note that these pre-processed (particularly lysed) samples are also considered a sample of monocytes herein: even though these do not contain whole monocytes anymore (as the cells are lysed), they are derived from a pure population of monocytes, so the gene expression is as found in the monocyte population.

Typically, when the at least one gene product whose expression is determined is mRNA, reverse transcription polymerase chain reaction (RT-PCR) is used, allowing very low copy numbers of mRNA to be detected. Briefly, a RNA strand is reverse transcribed into its DNA complement (complementary DNA, or cDNA) using the enzyme reverse transcriptase, and the resulting cDNA is amplified using PCR. However, methods to determine mRNA expression where no amplification is necessary also exist (e.g., nanostring technology).

When the at least one gene product whose expression is determined is protein, this is not amplified as there is no PCR procedure for proteins. However, to detect low abundant proteins, detection with primary and secondary antibodies can be performed to amplify the signal.

Determining expression levels at the mRNA levels is preferred, as it allows easy and reliable quantification. Of course, as the skilled person is well aware of, expression levels may be used as such, or normalized (e.g., against a reference gene or synthetic standards), in line with the routine protocols used in the art.

Thus, methods for diagnosing a disease are provided herein, comprising:
  a) Isolating, from a blood sample of said subject, a monocyte population;
  b) Determining in said monocyte population the expression or levels of expression of at least one gene product;
  c) Correlating the expression or levels of expression of the at least one gene product with the presence or absence of the disease in said subject.

As mentioned, the methods may also entail the prior obtaining of the blood sample, preferably not more than 6 hours prior to the isolation of the monocytes.

The methods provided herein are particularly useful for the diagnosis of cancer.

Gene products that show altered expression levels in monocytes when the subject has a disease are provided herein. Correlating the expression levels with the presence or absence of disease (step c) entails comparison of the expression levels of the at least one gene product determined in step b) with reference values (e.g., those of a healthy control) and based on the difference or similarity of these values conclude whether the subject has the disease. As explained earlier, the correlating step may entail a further step of grading the disease stage or severity; this is based on markers that have altered expression levels in early disease stages (e.g., non-metastasized cancer) as compared to late disease stages (e.g., metastasized cancer).

Distinct advantages of the present methods, apart from their remarkable sensitivity and specificity, are the minimal invasiveness of the methods, the fact that no dietary restrictions are necessary, and the speed of the procedure. Indeed, the protocols from drawing of the blood to comparing the expression values can be completed in less than 12 hours.

The methods described herein are also particularly useful to monitor evolution of the disease. This is because the gene signature retains plasticity. Monocytes will show an altered gene expression pattern quite rapidly (within hours rather than days) when exposed to an inflammatory stimulus in the body (e.g., the presence of cancer, such as colorectal cancer. This will happen even if the tumor is very small). However, when the stimulus is taken away (e.g., by surgically resecting the tumor), the monocytes will revert their gene expression to baseline values, and vice versa when the stimulus is introduced again.

Thus, according to particular embodiments, the methods provided herein are used for monitoring recurrence of a cancer. In other words, the subject from whom the monocytes are obtained is a subject that had cancer, but in which the cancer has been removed. The methods are then performed to evaluate whether the treatment of the cancer has been successful, or whether the tumor has returned. This is particularly envisaged for monitoring subjects who are at high risk of recurrence (for example, patients who had poorly differentiated tumors or venous or lymphatic invasion).

According to alternative, but not exclusive, particular embodiments, the methods are used for monitoring response to therapy. For example, once the subject has been diagnosed with cancer (using the methods described herein or alternative methods known in the art), and treatment for cancer has initiated, the present methods are performed again over time, to see whether the monocyte gene expression returns to baseline values (i.e., levels comparable to those found in healthy volunteers), as this would be indicative of a successful treatment and eradication of the tumor. It is envisaged that the present methods are particularly suited in determining minimal residual disease (MRD). MRD is the name given to small numbers of cancer cells that remain in the patient during treatment, or after treatment when the patient is in remission (no symptoms or signs of disease). In cancer treatment, MRD testing has several important roles: determining whether treatment has eradicated the cancer or whether traces remain, comparing the efficacy of different treatments, monitoring patient remission status and recurrence of the cancer and choosing the treatment that will best meet those needs (personalization of treatment). Given the fact that even very small tumors are detected with the present gene signature, it is particularly envisaged that the signature presented herein is highly suitable for MRD testing even when the patient has no other symptoms or signs of disease.

As the altered gene expression correlates to the presence of disease and can be used to monitor response to therapy, it is also envisaged that the methods provided herein may comprise an additional step of changing the treatment of the patient based on the results of the diagnosis. For instance, if the patient is receiving a combination of chemotherapeutics, but this does not result in gene expression in the monocytes reverting back to baseline values, this is indicative that the therapy does not work, and a decision may be taken to switch to a different chemotherapy regimen (e.g., different or additional drugs, or different doses of the same drugs).

Many different treatment options exist for colorectal cancer, by way of non-limiting examples, these include one or more of the following: local excision (for Stage 0 or Stage I tumors), radiotherapy, chemotherapy (e.g., with SFU, the FOLFOX regimen (oxaliplatin, 5-FU, and leucovorin), 5-FU and leucovorin, CapeOx (capecitabine plus oxaliplatin) or capecitabine alone, FOLFIRI (leucovorin, 5-FU, and irinotecan), FOLFOXIRI (leucovorin, 5-FU, oxaliplatin, and irinotecan), bevacizumab, cetuximab, irinotecan, panitumumab), and chemoradiation (combination of chemotherapy and radiation).

According to a further aspect of the disclosure, a gene signature is provided. This gene signature typically comprises at least two genes, wherein at least one gene is selected from the list of ACP5, ADM, ALDH1A1, APP, BAX, CD68, CTSZ, CXCR4, DDIT4, DNAJC7, ENSA, FCER1A, FKBP5, GPER, HBA1, HBB, HLA-DQA1, HMOX1, HP, IL1R2, LAPTM4A, LOC644063, LOC723972, RN28S1, S100P, SOCS3, TAF15, TKT, and TNF; and at least one other gene is selected from the genes listed in Table I, II, III and/or IV. Alternatively, at least one gene is selected from the list of ACP5, ADM, ALDH1A1, APP, BAX, CD68, CTSZ, CXCR4, DDIT4, FKBP5, GPER, HBA1, HBB, HP, LAPTM4A, LOC644063, S100P, SEPT5, SLPI, SOCS3, and TKT; and at least one other gene is selected from the genes listed in Tables I, II, III and/or IV.

Both the "at least one" gene, and the "at least one" other gene may, according to particular embodiments, and independent of each other, also be at least two, at least three, at least four, at least five, at least six, at least seven, at least eight, at least nine or at least ten.

According to further particular embodiments, at least two genes from the gene signature are selected from the list of ACP5, ADM, ALDH1A1, APP, BAX, CD68, CTSZ, CXCR4, DDIT4, DNAJC7, ENSA, FCER1A, FKBP5, GPER, HBA1, HBB, HLA-DQA1, HMOX1, HP, IL1R2, LAPTM4A, LOC644063, LOC723972, RN28S1, S100P, SOCS3, TAF15, TKT, and TNF (or from the alternative list of ACP5, ADM, ALDH1A1, APP, BAX, CD68, CTSZ, CXCR4, DDIT4, FKBP5, GPER, HBA1, HBB, HP, LAPTM4A, LOC644063, S100P, SEPT5, SLPI, SOCS3, and TKT). Since these genes are also present in Tables I, II, III and/or IV, this obviates the need for an additional gene from these tables (although further genes may still be added). According to yet further particular embodiments, at least 3, 4, 5, 6, 7 or 8 genes from the gene signature are selected from the list of ACP5, ADM, ALDH1A1, APP, BAX, CD68, CTSZ, CXCR4, DDIT4, DNAJC7, ENSA, FCER1A, FKBP5, GPER, HBA1, HBB, HLA-DQA1, HMOX1, HP, IL1R2, LAPTM4A, LOC644063, LOC723972, RN28S1, S100P, SOCS3, TAF15, TKT, and TNF (or from the alternative list of ACP5, ADM, ALDH1A1, APP, BAX, CD68, CTSZ, CXCR4, DDIT4, FKBP5, GPER, HBA1, HBB, HP, LAPTM4A, LOC644063, S100P, SEPT5, SLPI, SOCS3, and TKT).

Although the gene signature contains at least 2 genes, in practice the signature may contain more genes, e.g., at least 3 genes, at least 4 genes, at least 5 genes, at least 6 genes, at least 7 genes, at least 8 genes. When cost or technology is not limiting the number of genes the expression of which is determined, the gene signature may even contain at least 10 genes, at least 12 genes, at least 16 genes or at least 20 genes.

However, as it is envisaged that only up to a certain amount the gene expression will add extra information (e.g., confidence in prediction: added sensitivity or specificity), it is also envisaged that the gene signature contains no more than 50 genes, or no more than 40 genes, no more than 30 genes, no more than 25 genes, no more than 20 genes, no more than 16 genes, or no more than 12 genes. In this regard, it should be mentioned that some genes show co-regulation of expression and can be substituted for one another in the analysis. For instance, the information contained in the expression of CXCR4 correlates highly with that of TKT, and the information contained in the expression of HBA1 is highly correlated to that in HBB, so inclusion of both genes of such a gene pair may be redundant in a signature set.

Of course, the upper and lower limits described herein can be combined. Accordingly, typical gene signatures may comprise, e.g., between 2 and 20 genes, between 2 and 16 genes, between 3 and 16 genes, between 4 and 16 genes, between 3 and 12 genes, between 4 and 12 genes, etc. (with always at least one selected from the list of ACP5, ADM, ALDH1A1, APP, BAX, CD68, CTSZ, CXCR4, DDIT4, DNAJC7, ENSA, FCER1A, FKBP5, GPER, HBA1, HBB, HLA-DQA1, HMOX1, HP, IL1R2, LAPTM4A, LOC644063, LOC723972, RN28S1, S100P, SOCS3, TAF15, TKT, and TNF; and the others from that preferred list or from Tables I, II, III, and/or IV). According to alternative embodiments, at least one gene is selected from the list of ACP5, ADM, ALDH1A1, APP, BAX, CD68, CTSZ, CXCR4, DDIT4, FKBP5, GPER, HBA1, HBB, HP, LAPTM4A, LOC644063, S100P, SEPT5, SLPI, SOCS3, and TKT; and the others from that preferred list or from Tables I, II, III, and/or IV.

According to yet further particular embodiments, at least one gene is selected from the list of ADM, BAX, CD68, CTSZ, CXCR4, FKBP5, GPER, HBA1, HBB, LAPTM4A, S100P, and TKT, and optional others are selected from that same list, or from Tables I, II, III and/or IV.

According to very specific embodiments, the gene signature contains at least one gene whose expression is down-regulated in a disease setting, while the expression of at least one gene is up-regulated in this disease setting.

According to most specific embodiments, the gene signature is a monocyte gene signature, i.e., a group of genes with altered expression in monocytes, characteristic for a particular condition (particular cancer, most particular colorectal cancer).

Of note, although ideally all selected markers will show altered expression in patients (or metastatic patients) as compared to healthy controls, in practice not all markers will always reach significantly different expression levels (or the outcome is unsure). This is another reason why it is beneficial to assess expression of more than one marker. In such instances, it is envisaged that a sample is classified as positive (e.g., as indicative of the presence of disease) if at least a certain percentage of markers shows significantly different expression (higher or lower, depending on the marker). This may for instance be at least 50% of markers, at least 60% of markers, at least 70% of markers, at least 75% of markers, at least 80% of markers, at least 90% of markers, or even at least 95% of markers. Typically, the higher the number of genes whose expression is assessed, the lower the percentage of markers that needs to be positive to allow correlation with disease. For instance, when all 43 markers of Table IV are used, and 50% of them show significantly altered expression, this will be indicative of the presence of disease. On the other hand, when a panel of 16 (or 12) markers is used, it is typically envisaged that at least 70% (or even at least 75%) of them needs to show a significantly altered expression to correlate this to the presence of disease.

The gene signature is particularly useful in the field of medicine. Thus, according to specific embodiments, the gene signature provided herein is provided for use as a medicament. Particularly, it is provided for use as a diagnostic. More particularly, the gene signature provided herein is provided for use in the diagnosis of cancer. Most particularly, the gene signature provided herein is provided for use in the diagnosis of colorectal cancer.

According to a further aspect, kits are provided comprising means to detect the gene signature. For example, kits are provided that contain means to detect expression or levels of expression of at least two genes, wherein at least one gene is selected from the list of ACP5, ADM, ALDH1A1, APP, BAX, CD68, CTSZ, CXCR4, DDIT4, DNAJC7, ENSA, FCER1A, FKBP5, GPER, HBA1, HBB, HLA-DQA1, HMOX1, HP, IL1R2, LAPTM4A, LOC644063, LOC723972, RN28S1, S100P, SOCS3, TAF15, TKT, and TNF (or the alternative list of ACP5, ADM, ALDH1A1, APP, BAX, CD68, CTSZ, CXCR4, DDIT4, FKBP5, GPER, HBA1, HBB, HP, LAPTM4A, LOC644063, S100P, SEPT5, SLPI, SOCS3, and TKT); and at least one other gene is selected from the genes listed in Tables I, II, III and/or IV.

It is envisaged that these kits are provided for a particular purpose, such as for diagnosis of cancer, or more particularly, for the diagnosis of colorectal cancer.

The means to detect expression and/or expression levels of the at least two genes that are provided in the kits will depend on the methodology used to detect expression. As mentioned, detection can be on nucleic acid or protein level. For protein-based detection, the kits typically will contain antibodies for the at least two genes whose expression will be determined. Further control antibodies (e.g., against housekeeping genes) may also be provided in the kit.

Likewise, for detection at the nucleic acid level, the kits will typically contain primers or probes for the at least two genes whose expression will be determined. Further control primers and probes (e.g., against housekeeping genes) may also be provided in the kit.

The kit may further also contain standards or controls to check whether determining the expression has been done successfully (e.g., samples with known concentration of the at least two genes whose expression is determined, to compare the obtained values, or to check whether the detection reaction worked).

Of course, the kit may further comprise pharmaceutically acceptable excipients, buffers, and an instruction manual and so on.

It is to be understood that although particular embodiments, specific configurations as well as materials and/or molecules, have been discussed herein for cells and methods according to the disclosure, various changes or modifications in form and detail may be made without departing from the scope and spirit of this disclosure. The following examples are provided to better illustrate particular embodiments, and they should not be considered limiting the application. The application is limited only by the claims.

EXAMPLES

Example 1

Identification of Predictive Biomarkers by Gene Profiling of PBM from CRC Patients Three groups of untreated participants were enrolled to evaluate gene expression in monocytes. The first group included 27 newly diagnosed colorectal cancer patients with no sign of detectable metastasis (abbreviated as P). The second group included 28 cancer patients with clinically evident metastasis at the time of diagnosis (indicated as PM). The third group included 38 age and gender-matched healthy volunteers (HV). Venous peripheral blood (20 ml) was collected at the time of first diagnosis. Clinical-pathological characteristics of participants were determined at diagnosis such as gender, age, tumor localization, histological tumor grading, and tumor stages according to the TNM and International Union against Cancer (UICC) classifications. The exclusion criteria were the following: <45 and >75 years, previous history of oncological, inflammatory or autoimmune diseases, anti-inflammatory therapy, i.e., corticosteroids and NSAID at the time point of enrollment. Only Belgian cancer patients and healthy volunteers were enrolled in this monocentric study to reduce ethnical and environmental variability.

Isolation of monocytes from patients' peripheral blood was done using a two-step method: peripheral blood mononuclear cells (PBMNCs) were collected from fresh heparinized blood using a Ficoll density gradient and monocytes were isolated from PBMNCs by magnetic separation using magnetic microbeads conjugated to antibodies against CD14, a specific marker for human monocytes. Part of the PBM collected were used directly to study the gene expression profile while part of them were frozen to perform in vitro analysis (see further).

RNA was extracted from isolated monocytes and gene expression profiles of PBM were investigated by high-throughput screening using Illumina Bead Array platforms. Using statistical analysis of microarray expression data, a disease-specific genetic signature of maximum specificity and sensitivity was delineated, exploiting state-of-the art disease classification algorithms in biomarker development. The gene expression data was analyzed based on the Limma package from Bioconductor. At first, three groups were compared: metastatic patients (PM) versus healthy volunteers (HV), non-metastatic patients (P) versus HV, and PM versus P. In a separate additional analysis, the distinction between PM and P was omitted and this combined group, i.e., all patients with colorectal cancer, was compared towards HV.

1.1 Statistical Analysis of the Microarray Data

After quality assessment and data normalization on the 93 samples, differentially expressed genes between the groups can be assessed.

1.1.1 Data Filtering

The total number of probes on the array is 47,323. For each probe, we count the number of present detection calls, over all samples. This ranges between 0 (none are present) and 93 (all are present). We omit the probes that were absent for all samples (i.e., number of present calls=0) from the analysis. This subset consists out of 18,396 probes. Hence analysis is performed for 28,927 probes.

1.1.2 Assessing Differentially Expressed Probes

We compare the normalized expression values of the different conditions with the limma package of Bioconductor (Smyth, 2004; Smyth, 2005). We estimate an average expression value for the three groups:

1. HV (#=38 samples)
2. PM (#=28 samples)
3. P (#=27 samples)

Based on these estimates, we can estimate the contrasts of interest. In a second similar analysis, we compute the estimates for the combined group of PM and P (#=55 samples) and we estimate the contrast of (PM, P) versus HV. For each of the contrasts, we test whether it is significantly deviating from 0 with a moderated t-statistic (implemented in limma). The resulting p-values are corrected for multiple testing with Benjamini-Hochberg (Benjamini and Hochberg, 1995) to control the false discovery rate.

Different selection methods can be applied for the selection of differentially expressed genes. One can select based on the p-values, corrected for multiple testing, e.g., all probes with a corrected p-value less than 0.05. Or, one can apply a more stringent cut-off of the uncorrected p-values, e.g., p<0.001. A cut off on the p-values can be combined with a cut-off on the fold-change. By way of example, combining a cutoff of p<0.05 after multiple testing correction according to Benjamini-Hochberg with a cut-off set to only select the genes showing a minimum fold change of 1.5 (log-ratios to 0.58) yields the following numbers of differentially expressed genes.

| Comparison | p < 0.05 | |
|---|---|---|
| | Log-ratio <−0.58 | Log-ratio >0.58 |
| PM versus HV | 4 | 29 |
| P versus HV | 5 | 26 |

-continued

| | p < 0.05 | |
|---|---|---|
| Comparison | Log-ratio <−0.58 | Log-ratio >0.58 |
| PM versus P | 0 | 0 |
| (PM, P) versus HV | 4 | 36 |

(negative log ratios indicate genes that are down-regulated, positive log ratios are genes that are up-regulated).

The analysis showed that there was a broad overlap in the gene signature of PBM from non-metastatic and metastatic patients, indicating that this signature already exists in the early stages of CRC and remains stable during the progression towards metastatic CRC. Based on this, we decided to assess the performance of the gene signature of (PM, P) versus HV as diagnostic tool.

1.2 Construction of Gene Signatures

For most datasets, the limma method is a very reliable approach for constructing a gene signature. However, to optimize the limma-signature even further, alternative signatures are constructed, evaluated with classification approaches and finally merged with the limma signature. Seven different approaches to construct gene signatures were used. Five of them are combinations of three ranking methods, followed by one of two feature selection modes.

The three ranking methods are based on limma (Smyth, 2004), DEDS (Hwa and Yuanyuan, 2005) or PCA. The limma-ranking ranks genes according to uncorrected p-values. With the DEDS package, we rank genes based on several criteria simultaneously (including fold changes, ordinary t-statistics, ordinary F-statistics, moderated t-statistics, moderated F-statistics, SAM (significance analysis for microarrays) statistics and B-statistics). We use simple Euclidean distance to evaluate contributions from different statistics. PCA-ranking starts with principal component analysis. We evaluate every component with a t-test for its capacity to distinguish between sample classes and retain the five components with smallest p-values. To each probe set, a weight is attributed in accordance to its contribution in such a principal component (Eijssen et al., 2008). Weights from several components are combined by a weighted sum, with weights in accordance to the singular value of the component. The weights are used for the so called PCA-ranking. The two modes of feature selection that we use after ranking are filtering or wrapping. With filtering, we use a fixed criterion to decide which top genes from the ranking we will select. For filtering after limma-ranking, we use a stringent cut-off on the p-values of the moderated t-statistic, e.g., p<0.001, combined with a cut-off on fold-change of two (i.e., an absolute log 2-ratio larger than 1). For filtering after DEDS-ranking, we select only differentially expressed genes with a p-value <0.05. For filtering after PCA-ranking, we select only the 5*nsamps top genes from the ranking, with nsamps equal to the number of samples in the dataset. With wrapping the top-1 to top-nsamps are step-wise presented for further classification (see below) (Daemen et al., 2009).

Finally, two approaches to construct gene signatures use an embedded filtering mode (Saeys et al., 2007). No ranking is performed: nearest shrunken centroid and random forests (see below) have an internal procedure for direct feature selection.

1.2.1 Evaluation of Gene Signatures

Gene signatures are evaluated by their predictive power, i.e., how good can we discriminate between the two sample classes when limiting our view only to the expression of the genes in the signature. To determine the predictive power, we compare five different classification algorithms (Statnikov et al., 2008) since no single algorithm outperforms the others on every dataset: k-Nearest-Neighbor (kNN) (Cover and Hart, 1967), support vector machine (SVM) (Burges, 1998), nearest shrunken centroid (NSC) (Tibshirani et al., 2002), random forest (RF) (Diaz-Uriarte and Alvarez de Andres, 2006), and ensemble method (Dietterich, 2000). All together, we consider 24 classification approaches, which are specific combinations of classification algorithms, feature selection modes and ranking methods.

As training and evaluation framework we use Monte Carlo cross-validation (MCCV) with an outer and inner loop (Wessels et al., 2005).

To create balanced datasets, in each cycle excess samples are randomly removed from the training data.

The predictive performance of a classification approach is measured by its balanced error rate (BER). When several approaches have the same optimal BER, we check which one has the lowest area under the ROC curve (AUC) (Bradley, 1997). We select the approach with the lowest BER (or highest AUC) as the optimal approach. To compute the BER, we need the discrete class predictions. For the AUC, we use the continuous prediction values of the approaches.

After a MCCV run, we can compute for each of the 24 classification approaches a ROC-curve that gives a visual overview of the trade-off between sensitivity and specificity. A selection of these curves is shown in FIGS. 1A and 1B. It can be seen that many of these approaches not only perform quite well, but also have similar ROC curves.

1.2.2 Optimization of Gene Signature for Functional Analysis

After the evaluation, we select the optimal classification approach and two "second-best" approaches that have alternative gene signatures as input. Here, we opted for NSC_ALL_embedded as optimal approach. As "second-best" approaches with alternative signatures, we take SVM_LIMMA_wrapper and SVM_DEDS_wrapper. These three approaches are then trained on the complete dataset. However, training should best be conducted on a balanced dataset (equal number of samples in each class). Therefore, as during the evaluation scheme, a random set of samples is discarded to make the dataset balanced. To compensate for the random element that is introduced by this procedure, we repeat the balance-correcting scheme 25 times, each time discarding another random set of samples. In this way, we compute for each gene the reproducibility score, i.e., the percentage of repeats in which this probe was selected for the gene signature. The three balance-corrected signatures are then identified as the sets consisting of genes with a reproducibility score >75.

Alternative methods for the selection of gene signatures often select different gene sets from the same pathways (Shi et al., 2010; Statnikov and Aliferis, 2010). Hence, in order to create gene signatures with optimal stability/reproducibility and biological interpretability, alternative, good signatures may be merged into one final signature. Therefore, we assemble the final gene signature as the union of the limma-signature and the balance-corrected signatures of the optimal classifier and two second-best classifiers. The final, merged signature contains 336 probes. The list of probes and corresponding target genes is shown in Table I. Based on balanced error rates, we estimate that a SVM-classifier with the signature as input would classify correctly about 93% of cases (in a balanced setup).

TABLE I

List of target genes identified by Illumina analysis, together with an indication whether they are up-regulated (positive log ratio or "up") or down-regulated (negative log ratio or "down").

| Log ratio PMP vs. HV | Target ID | ACCESSION | DEFINITION |
|---|---|---|---|
| 1.425282722 | HBA2 | NM_000517.3 (SEQ ID NO: 1) | *Homo sapiens* hemoglobin, alpha 2 (HBA2), mRNA. |
| 1.287783085 | HBA2 | NM_000517.3 (SEQ ID NO: 1) | *Homo sapiens* hemoglobin, alpha 2 (HBA2), mRNA. |
| 1.256987293 | HBB | NM_000518.4 (SEQ ID NO: 2) | *Homo sapiens* hemoglobin, beta (HBB), mRNA. |
| 1.222508533 | HBA1 | NM_000558.3 (SEQ ID NO: 3) | *Homo sapiens* hemoglobin, alpha 1 (HBA1), mRNA. |
| 0.998509041 | ADM | NM_001124.1 (SEQ ID NO: 4) | *Homo sapiens* adrenomedullin (ADM), mRNA. |
| 0.991062267 | TAF15 | NM_139215.1 (SEQ ID NO: 5) | *Homo sapiens* TAF15 RNA polymerase II, TATA box binding protein (TBP)-associated factor, 68 kDa (TAF15), transcript variant 1, mRNA. |
| 0.836689364 | CTSZ | NM_001336.2 (SEQ ID NO: 6) | *Homo sapiens* cathepsin Z (CTSZ), mRNA. |
| 0.819643571 | TAF15 | NM_003487.2 (SEQ ID NO: 7) | *Homo sapiens* TAF15 RNA polymerase II, TATA box binding protein (TBP)-associated factor, 68 kDa (TAF15), transcript variant 2, mRNA. |
| 0.777181029 | DDIT4 | NM_019058.2 (SEQ ID NO: 8) | *Homo sapiens* DNA-damage-inducible transcript 4 (DDIT4), mRNA. |
| 0.725481681 | LOC100132394 | XM_001713809.1 (SEQ ID NO: 9) | PREDICTED: *Homo sapiens* hypothetical protein LOC100132394 (LOC100132394), mRNA. |
| 0.688401645 | LOC153561 | NM_207331.2 (SEQ ID NO: 10) | *Homo sapiens* hypothetical protein LOC153561 (LOC153561), mRNA. |
| 0.682952046 | FKBP5 | NM_004117.2 (SEQ ID NO: 11) | *Homo sapiens* FK506 binding protein 5 (FKBP5), mRNA. |
| 0.682258483 | HS.61208 | BF434110 (SEQ ID NO: 12) | 7o98h02.x1 NCI_CGAP_Ov18 *Homo sapiens* cDNA clone IMAGE: 36444033, mRNA sequence |
| 0.672157697 | DNAJC7 | NM_003315.1 (SEQ ID NO: 13) | *Homo sapiens* DnaJ (Hsp40) homolog, subfamily C, member 7 (DNAJC7), mRNA. |
| 0.662987224 | GPER | NM_001039966.1 (SEQ ID NO: 14) | *Homo sapiens* G protein-coupled estrogen receptor 1 (GPER), transcript variant 3, mRNA. |
| 0.646983223 | SEPT5 | NM_002688.4 (SEQ ID NO: 15) | *Homo sapiens* septin 5 (SEPT5), mRNA. |
| 0.645562444 | TKT | NM_001064.1 (SEQ ID NO: 16) | *Homo sapiens* transketolase (Wernicke-Korsakoff syndrome) (TKT), mRNA. |
| 0.644703597 | LOC649143 | XM_944822.1 (SEQ ID NO: 17) | PREDICTED: *Homo sapiens* similar to HLA class II histocompatibility antigen, DRB1-9 beta chain precursor (MHC class I antigen DRB1*9) (DR-9) (DR9), transcript variant 2 (LOC649143), mRNA. |
| 0.629326367 | LOC100008589 | NR_003287.1 (SEQ ID NO: 18) | *Homo sapiens* 28S ribosomal RNA (LOC100008589), non-coding RNA. |
| 0.626313819 | HP | NM_005143.2 (SEQ ID NO: 19) | *Homo sapiens* haptoglobin (HP), mRNA. |
| 0.626113556 | GPER | NM_001039966.1 (SEQ ID NO: 14) | *Homo sapiens* G protein-coupled estrogen receptor 1 (GPER), transcript variant 3, mRNA. |
| 0.625858859 | LOC100170939 | NR_024054.1 (SEQ ID NO: 20) | *Homo sapiens* glucuronidase, beta pseudogene (LOC100170939), non-coding RNA. |
| 0.618893497 | HMOX1 | NM_002133.1 (SEQ ID NO: 21) | *Homo sapiens* heme oxygenase (decycling) 1 (HMOX1), mRNA. |
| 0.616165331 | S100P | NM_005980.2 (SEQ ID NO: 22) | *Homo sapiens* S100 calcium binding protein P (S100P), mRNA. |
| 0.61127259 | LOC100134364 | XM_001713810.1 (SEQ ID NO: 23) | PREDICTED: *Homo sapiens* hypothetical protein LOC100134364 (LOC100134364), mRNA. |
| 0.604580071 | SLC39A1 | NM_014437.3 (SEQ ID NO: 24) | *Homo sapiens* solute carrier family 39 (zinc transporter), member 1 (SLC39A1), mRNA. |
| 0.597605882 | HS.143909 | BX106581 (SEQ ID NO: 25) | BX106581 Soares_testis_NHT *Homo sapiens* cDNA clone IMAGp998E204492, mRNA sequence |

TABLE I-continued

List of target genes identified by Illumina analysis, together with an indication whether they are up-regulated (positive log ratio or "up") or down-regulated (negative log ratio or "down").

| Log ratio PMP vs. HV | Target ID | ACCESSION | DEFINITION |
| --- | --- | --- | --- |
| 0.593231994 | SOCS3 | NM_003955.3 (SEQ ID NO: 26) | *Homo sapiens* suppressor of cytokine signaling 3 (SOCS3), mRNA. |
| 0.582007674 | BAX | NM_138765.2 (SEQ ID NO: 27) | *Homo sapiens* BCL2-associated X protein (BAX), transcript variant sigma, mRNA. |
| 0.567951821 | HS.581828 | BG207842 (SEQ ID NO: 28) | RST27329 Athersys RAGE Library *Homo sapiens* cDNA, mRNA sequence |
| 0.560181209 | LOC723972 | NR_003144.1 (SEQ ID NO: 29) | *Homo sapiens* hepatopoietin PCn127 (LOC723972), non-coding RNA. |
| 0.558747252 | LOC100190986 | NR_024456.1 (SEQ ID NO: 30) | *Homo sapiens* hypothetical LOC100190986 (LOC100190986), non-coding RNA. |
| 0.556694791 | UPP1 | NM_003364.2 (SEQ ID NO: 31) | *Homo sapiens* uridine phosphorylase 1 (UPP1), transcript variant 1, mRNA. |
| 0.555850341 | AQP9 | NM_020980.2 (SEQ ID NO: 32) | *Homo sapiens* aquaporin 9 (AQP9), mRNA. |
| 0.545469818 | TNPO1 | NM_153188.2 (SEQ ID NO: 33) | *Homo sapiens* transportin 1 (TNPO1), transcript variant 2, mRNA. |
| 0.53910369 | BRD3 | NM_007371.2 (SEQ ID NO: 34) | *Homo sapiens* bromodomain containing 3 (BRD3), mRNA. |
| 0.533994393 | SLC2A3 | NM_006931.1 (SEQ ID NO: 35) | *Homo sapiens* solute carrier family 2 (facilitated glucose transporter), member 3 (SLC2A3), mRNA. |
| 0.532202222 | ACP2 | NM_001610.1 (SEQ ID NO: 36) | *Homo sapiens* acid phosphatase 2, lysosomal (ACP2), mRNA. |
| 0.515055033 | TMBIM1 | NM_022152.4 (SEQ ID NO: 37) | *Homo sapiens* transmembrane BAX inhibitor motif containing 1 (TMBIM1), mRNA. |
| 0.506880701 | RNF146 | NM_030963.2 (SEQ ID NO: 38) | *Homo sapiens* ring finger protein 146 (RNF146), mRNA. |
| 0.495913441 | CHD8 | NM_020920.2 (SEQ ID NO: 39) | *Homo sapiens* chromodomain helicase DNA binding protein 8 (CHD8), mRNA. |
| 0.490191625 | PIK3R1 | NM_181523.1 (SEQ ID NO: 40) | *Homo sapiens* phosphoinositide-3-kinase, regulatory subunit 1 (alpha) (PIK3R1), transcript variant 1, mRNA. |
| 0.483060794 | HS.313056 | BM974067 (SEQ ID NO: 41) | UI-CF-EC1-abz-d-11-0-UI.s1 UI-CF-EC1 Homo sapiens cDNA clone UI-CF-EC1-abz-d-11-0-UI 3, mRNA sequence |
| 0.479167584 | LOC440345 | XM_933717.1 (SEQ ID NO: 42) | PREDICTED: *Homo sapiens* hypothetical protein LOC440345, transcript variant 6 (LOC440345), mRNA. |
| 0.473451156 | FCGR1A | NM_000566.2 (SEQ ID NO: 43) | *Homo sapiens* Fc fragment of IgG, high affinity Ia, receptor (CD64) (FCGR1A), mRNA. |
| 0.473233358 | HS.565917 | AW451125 (SEQ ID NO: 44) | UI-H-BI3-alg-g-11-0-UI.s1 NCI_CGAP_Sub5 *Homo sapiens* cDNA clone IMAGE: 2736956 3, mRNA sequence |
| 0.472244147 | LOC646103 | XM_377879.3 (SEQ ID NO: 45) | PREDICTED: *Homo sapiens* similar to TBP-associated factor 11 (LOC646103), mRNA. |
| 0.471640717 | HS.545048 | AL042883 (SEQ ID NO: 46) | DKFZp434I1922_s1 434 (synonym: htes3) *Homo sapiens* cDNA clone DKFZp434I1922 3, mRNA sequence |
| 0.469623319 | CLEC4D | NM_080387.4 (SEQ ID NO: 47) | *Homo sapiens* C-type lectin domain family 4, member D (CLEC4D), mRNA. |
| 0.466971624 | LOC728069 | XM_001128421.1 (SEQ ID NO: 48) | PREDICTED: *Homo sapiens* hypothetical LOC728069 (LOC728069), mRNA. |
| 0.45205922 | HS.543412 | AW237129 (SEQ ID NO: 49) | xm65h05.x1 NCI_CGAP_GC6 *Homo sapiens* cDNA clone IMAGE: 2689113 3, mRNA sequence |
| 0.451555789 | HS.291195 | BX105310 (SEQ ID NO: 50) | BX105310 Soares_testis_NHT *Homo sapiens* cDNA clone IMAGp998J212640, mRNA sequence |
| 0.448701357 | SDHC | NM_003001.2 (SEQ ID NO: 51) | *Homo sapiens* succinate dehydrogenase complex, subunit C, integral membrane protein, 15 kDa (SDHC), nuclear gene encoding mitochondrial protein, mRNA. |

TABLE I-continued

List of target genes identified by Illumina analysis, together with an indication whether they are up-regulated (positive log ratio or "up") or down-regulated (negative log ratio or "down").

| Log ratio PMP vs. HV | Target ID | ACCESSION | DEFINITION |
|---|---|---|---|
| 0.448161441 | MCOLN1 | NM_020533.1 (SEQ ID NO: 52) | *Homo sapiens* mucolipin 1 (MCOLN1), mRNA. |
| 0.443476719 | LOC642771 | XM_926193.1 (SEQ ID NO: 53) | PREDICTED: *Homo sapiens* similar to Golgi autoantigen, golgin subfamily A member 2 (Golgi matrix protein GM130) (LOC642771), mRNA. |
| 0.442898675 | ZNF33A | NM_006974.2 (SEQ ID NO: 54) | *Homo sapiens* zinc finger protein 33A (ZNF33A), transcript variant 2, mRNA. |
| 0.435332776 | HS.552008 | CA429430 (SEQ ID NO: 55) | UI-H-FH1-bfm-b-13-0-UI.s1 NCI_CGAP_FH1 *Homo sapiens* cDNA clone UI-H-FH1-bfm-b-13-0-UI 3, mRNA sequence |
| 0.435041868 | DYSF | NM_003494.2 (SEQ ID NO: 56) | *Homo sapiens* dysferlin, limb girdle muscular dystrophy 2B (autosomal recessive) (DYSF), mRNA. |
| 0.428415348 | HS.121635 | AW173314 (SEQ ID NO: 57) | xj85h08.x1 Soares_NFL_T_GBC_S1 *Homo sapiens* cDNA clone IMAGE: 2664063 3 similar to contains TAR1.t2 TAR1 repetitive element;, mRNA sequence |
| 0.425975261 | HS.571207 | BX119561 (SEQ ID NO: 58) | BX119561 NCI_CGAP_Kid11 *Homo sapiens* cDNA clone IMAGp998K155924; IMAGE: 2385542, mRNA sequence |
| 0.425348595 | HS.564676 | AW298401 (SEQ ID NO: 59) | UI-H-BW0-ajj-h-10-0-UI.s1 NCI_CGAP_Sub6 *Homo sapiens* cDNA clone IMAGE: 2732035 3, mRNA sequence |
| 0.419931568 | HS.539119 | DB337375 (SEQ ID NO: 60) | DB337375 TESTI2 *Homo sapiens* cDNA clone TESTI2020522 3, mRNA sequence |
| 0.419918039 | HS.582550 | BG208291 (SEQ ID NO: 61) | RST27783 Athersys RAGE Library *Homo sapiens* cDNA, mRNA sequence |
| 0.41773203 | HS.565086 | BF512455 (SEQ ID NO: 62) | UI-H-BI3-alw-d-07-0-UI.s1 NCI_CGAP_Sub5 *Homo sapiens* cDNA clone IMAGE: 3068964 3, mRNA sequence |
| 0.415707991 | HS.582136 | CN288601 (SEQ ID NO: 63) | 17000583181795 GRN_PRENEU *Homo sapiens* cDNA 5, mRNA sequence |
| 0.414728151 | AIF1L | NM_031426.2 (SEQ ID NO: 64) | *Homo sapiens* allograft inflammatory factor 1-like (AIF1L), transcript variant 1, mRNA. |
| 0.40310815 | HS.126573 | BX109006 (SEQ ID NO: 65) | BX109006 NCI_CGAP_Lu5 *Homo sapiens* cDNA clone IMAGp998C013947, mRNA sequence |
| 0.402219324 | HS.571035 | BC033504 (SEQ ID NO: 66) | *Homo sapiens*, clone IMAGE: 5168221, mRNA |
| 0.401439862 | CST7 | NM_003650.2 (SEQ ID NO: 67) | *Homo sapiens* cystatin F (leukocystatin) (CST7), mRNA. |
| 0.400934362 | IER3 | NM_003897.3 (SEQ ID NO: 68) | *Homo sapiens* immediate early response 3 (IER3), mRNA. |
| 0.399831112 | PLIN2 | NM_001122.2 (SEQ ID NO: 69) | *Homo sapiens* perilipin 2 (PLIN2), mRNA. |
| 0.398348917 | LOC642981 | XM_927840.1 (SEQ ID NO: 70) | PREDICTED: *Homo sapiens* hypothetical protein LOC642981 (LOC642981), mRNA. |
| 0.39472666 | HS.543617 | AI004472 (SEQ ID NO: 71) | ot56f09.s1 Soares_testis_NHT *Homo sapiens* cDNA clone IMAGE: 1620809 3, mRNA sequence |
| 0.394580918 | HS.210969 | AI827892 (SEQ ID NO: 72) | wf12a11.x1 Soares_NFL_T_GBC_S1 *Homo sapiens* cDNA clone IMAGE: 2350364 3, mRNA sequence |
| 0.3945452 | ARHGAP26 | NM_015071.3 (SEQ ID NO: 73) | *Homo sapiens* Rho GTPase activating protein 26 (ARHGAP26), mRNA. |
| 0.393515945 | HNRNPA3 | NM_194247.2 (SEQ ID NO: 74) | *Homo sapiens* heterogeneous nuclear ribonucleoprotein A3 (HNRNPA3), mRNA. |
| 0.391976411 | HS.563406 | AI807179 (SEQ ID NO: 75) | wf25f10.x1 Soares_NFL_T_GBC_S1 *Homo sapiens* cDNA clone IMAGE: 2356651 3, mRNA sequence |

TABLE I-continued

List of target genes identified by Illumina analysis, together with an indication whether they are up-regulated (positive log ratio or "up") or down-regulated (negative log ratio or "down").

| Log ratio PMP vs. HV | Target ID | ACCESSION | DEFINITION |
|---|---|---|---|
| 0.386122147 | HS.548213 | AI630987 (SEQ ID NO: 76) | tx54c03.x1 NCI_CGAP_Lu24 *Homo sapiens* cDNA clone IMAGE: 2273380 3, mRNA sequence |
| 0.38483405 | HS.566751 | BU753911 (SEQ ID NO: 77) | UI-1-BC1p-ali-e-01-0-UI.s1 NCI_CGAP_P13 *Homo sapiens* cDNA clone UI-1-BC1p-ali-e-01-0-UI 3, mRNA sequence |
| 0.381909307 | HS.582025 | AI066603 (SEQ ID NO: 78) | ov47h04.x1 Soares_testis_NHT *Homo sapiens* cDNA clone IMAGE: 1640503 3, mRNA sequence |
| 0.381489485 | C15ORF28 | XR_001373.1 (SEQ ID NO: 79) | PREDICTED: *Homo sapiens* chromosome 15 open reading frame 28 (C15orf28), misc RNA. |
| 0.378073188 | HS.562624 | BF445990 (SEQ ID NO: 80) | 7p17e02.x1 NCI_CGAP_Br22 *Homo sapiens* cDNA clone IMAGE: 3646155 3, mRNA sequence |
| 0.377535176 | HS.544451 | BE646244 (SEQ ID NO: 81) | 7e83f02.x1 NCI_CGAP_Pr28 *Homo sapiens* cDNA clone IMAGE: 3289083 3, mRNA sequence |
| 0.376981852 | LOC100132106 | XM_001720398.1 (SEQ ID NO: 82) | PREDICTED: *Homo sapiens* hypothetical protein LOC100132106 (LOC100132106), mRNA. |
| 0.373731718 | HS.565708 | AI961498 (SEQ ID NO: 83) | wt23e07.x1 NCI_CGAP_Ut1 *Homo sapiens* cDNA clone IMAGE: 2508324 3, mRNA sequence |
| 0.371608825 | VWA5A | NM_014622.4 (SEQ ID NO: 84) | *Homo sapiens* von Willebrand factor A domain containing 5A (VWA5A), transcript variant 1, mRNA. |
| 0.367860736 | HS.535906 | BF336512 (SEQ ID NO: 85) | RC2-CT0522-150900-012-g04 CT0522 *Homo sapiens* cDNA, mRNA sequence |
| 0.367366826 | HS.551330 | BE855955 (SEQ ID NO: 86) | 7f85c09.x1 NCI_CGAP_Pr28 *Homo sapiens* cDNA clone IMAGE: 3303760 3, mRNA sequence |
| 0.365391324 | LOC150568 | NR_015399.1 (SEQ ID NO: 87) | *Homo sapiens* hypothetical LOC150568 (LOC150568), non-coding RNA. |
| 0.360112404 | SLC35E3 | NM_018656.2 (SEQ ID NO: 88) | *Homo sapiens* solute carrier family 35, member E3 (SLC35E3), mRNA. |
| 0.35682846 | HS.555208 | BM673749 (SEQ ID NO: 89) | UI-E-EJ0-ahh-i-01-0-UI.s1 UI-E-EJ0 *Homo sapiens* cDNA clone UI-E-EJ0-ahh-i-01-0-UI 3, mRNA sequence |
| 0.355509912 | HS.545044 | CD101933 (SEQ ID NO: 90) | AGENCOURT_13980472 NIH_MGC_187 *Homo sapiens* cDNA clone IMAGE: 30373500 5, mRNA sequence |
| 0.354656089 | KCNQ1OT1 | NR_002728.2 (SEQ ID NO: 91) | *Homo sapiens* KCNQ1 overlapping transcript 1 (non-protein coding) (KCNQ1OT1), non-coding RNA. |
| 0.354642051 | MYST3 | NM_006766.2 (SEQ ID NO: 92) | *Homo sapiens* MYST histone acetyltransferase (monocytic leukemia) 3 (MYST3), mRNA. |
| 0.351655619 | CCDC135 | NM_032269.4 (SEQ ID NO: 93) | *Homo sapiens* coiled-coil domain containing 135 (CCDC135), mRNA. |
| 0.351180052 | HIST1H1C | NM_005319.3 (SEQ ID NO: 94) | *Homo sapiens* histone cluster 1, H1c (HIST1H1C), mRNA. |
| 0.349986275 | LOC653158 | XM_926814.1 (SEQ ID NO: 95) | PREDICTED: *Homo sapiens* similar to hypothetical protein MGC40405, transcript variant 1 (LOC653158), mRNA. |
| 0.348685879 | HS.543863 | AW297072 (SEQ ID NO: 96) | UI-H-BI2-aie-a-06-0-UI.s1 NCI_CGAP_Sub4 *Homo sapiens* cDNA clone IMAGE: 2728978 3, mRNA sequence |
| 0.348167026 | HS.35496 | BX095709 (SEQ ID NO: 97) | BX095709 Soares pineal gland 3NbHPG *Homo sapiens* cDNA clone IMAGp998I24464, mRNA sequence |
| 0.348125204 | HS.575808 | CF552427 (SEQ ID NO: 98) | AGENCOURT_15595604 NIH_MGC_183 *Homo sapiens* cDNA clone IMAGE: 30530228 5, mRNA sequence |
| 0.347800469 | HS.545251 | BG192152 (SEQ ID NO: 99) | RST11259 Athersys RAGE Library *Homo sapiens* cDNA, mRNA sequence |
| 0.344344566 | C22ORF33 | NM_178552.2 (SEQ ID NO: 100) | *Homo sapiens* chromosome 22 open reading frame 33 (C22orf33), mRNA. |

TABLE I-continued

List of target genes identified by Illumina analysis, together with an
indication whether they are up-regulated (positive log ratio or "up") or
down-regulated (negative log ratio or "down").

| Log ratio PMP vs. HV | Target ID | ACCESSION | DEFINITION |
|---|---|---|---|
| 0.344271659 | HS.491292 | AK093878 (SEQ ID NO: 101) | *Homo sapiens* cDNA FLJ36559 fis, clone TRACH2009291 |
| 0.343675138 | HHATL | NM_020707.2 (SEQ ID NO: 102) | *Homo sapiens* hedgehog acyltransferase-like (HHATL), mRNA. |
| 0.342947982 | GPR101 | NM_054021.1 (SEQ ID NO: 103) | *Homo sapiens* G protein-coupled receptor 101 (GPR101), mRNA. |
| 0.342895802 | HS.117299 | BX110173 (SEQ ID NO: 104) | BX110173 NCI_CGAP_GCB1 *Homo sapiens* cDNA clone IMAGp998L023103, mRNA sequence |
| 0.341430987 | HS.377021 | AL832228 (SEQ ID NO: 105) | *Homo sapiens* mRNA; cDNA DKFZp686P2136 (from clone DKFZp686P2136) |
| 0.339934182 | HIVEP2 | NM_006734.3 (SEQ ID NO: 106) | *Homo sapiens* human immunodeficiency virus type I enhancer binding protein 2 (HIVEP2), mRNA. |
| 0.338809944 | CCDC69 | NM_015621.2 (SEQ ID NO: 107) | *Homo sapiens* coiled-coil domain containing 69 (CCDC69), mRNA. |
| 0.334035597 | STK16 | NM_003691.2 (SEQ ID NO: 108) | *Homo sapiens* serine/threonine kinase 16 (STK16), transcript variant 1, mRNA. |
| 0.333993469 | HS.538083 | AI191966 (SEQ ID NO: 109) | qe07b12.x1 Soares_testis_NHT *Homo sapiens* cDNA clone IMAGE: 1738271 3, mRNA sequence |
| 0.33374597 | FLVCR2 | NM_017791.1 (SEQ ID NO: 110) | *Homo sapiens* feline leukemia virus subgroup C cellular receptor family, member 2 (FLVCR2), mRNA. |
| 0.332804727 | H2AFJ | NM_177925.2 (SEQ ID NO: 111) | *Homo sapiens* H2A histone family, member J (H2AFJ), transcript variant 1, mRNA. |
| 0.332656128 | PLEKHN1 | NM_032129.1 (SEQ ID NO: 112) | *Homo sapiens* pleckstrin homology domain containing, family N member 1 (PLEKHN1), mRNA. |
| 0.332640503 | HS.541892 | AW337309 (SEQ ID NO: 113) | xw83e08.x1 NCI_CGAP_Pan1 *Homo sapiens* cDNA clone IMAGE: 2834630 3, mRNA sequence |
| 0.330593234 | HS.580943 | AW661763 (SEQ ID NO: 114) | hi80e01.x1 Soares_NFL_T_GBC_S1 *Homo sapiens* cDNA clone IMAGE: 2978616 3, mRNA sequence |
| 0.328876547 | HS.580515 | R35106 (SEQ ID NO: 115) | yg59f10.r1 Soares infant brain 1NIB *Homo sapiens* cDNA clone IMAGE: 36955 5, mRNA sequence |
| 0.328580838 | RNF122 | NM_024787.2 (SEQ ID NO: 116) | *Homo sapiens* ring finger protein 122 (RNF122), mRNA. |
| 0.325996187 | LOC100130934 | XM_001716314.1 (SEQ ID NO: 117) | PREDICTED: *Homo sapiens* similar to zinc finger protein 663 (LOC100130934), mRNA. |
| 0.324899249 | HS.128234 | BX098198 (SEQ ID NO: 118) | BX098198 Soares_NFL_T_GBC_S1 *Homo sapiens* cDNA clone IMAGp998L014015, mRNA sequence |
| 0.321175844 | HS.541852 | BX115082 (SEQ ID NO: 119) | BX115082 Soares_NFL_T_GBC_S1 *Homo sapiens* cDNA clone IMAGp998J194538, mRNA sequence |
| 0.320655111 | HS.374832 | DA086964 (SEQ ID NO: 120) | DA086964 BRACE2 *Homo sapiens* cDNA clone BRACE2041741 5, mRNA sequence |
| 0.31731102 | HS.178244 | AA448469 (SEQ ID NO: 121) | zw80a10.s1 Soares_testis_NHT *Homo sapiens* cDNA clone IMAGE: 782490 3, mRNA sequence |
| 0.316510734 | PDE7A | NM_002604.1 (SEQ ID NO: 122) | *Homo sapiens* phosphodiesterase 7A (PDE7A), transcript variant 2, mRNA. |
| 0.315370885 | HS.212582 | BX642767 (SEQ ID NO: 123) | DKFZp781H2216_r1 781 (synonym: hlcc4) *Homo sapiens* cDNA clone DKFZp781H2216 5, mRNA sequence |
| 0.315356998 | HS.584731 | AA431552 (SEQ ID NO: 124) | zw78d11.r1 Soares_testis_NHT *Homo sapiens* cDNA clone IMAGE: 782325 5 similar to contains element TAR1 repetitive element;, mRNA sequence |
| 0.314600565 | HS.584259 | DR731427 (SEQ ID NO: 125) | MGC4.2.1.4.1.F12.F.1 NIH_MGC_331 *Homo sapiens* cDNA clone MGC4.2.1.4.1.F12, mRNA sequence |
| 0.312073933 | HS.562205 | BE042871 (SEQ ID NO: 126) | ho30a11.x1 NCI_CGAP_Lu24 *Homo sapiens* cDNA clone IMAGE: 3038876 3, mRNA sequence |

TABLE I-continued

List of target genes identified by Illumina analysis, together with an indication whether they are up-regulated (positive log ratio or "up") or down-regulated (negative log ratio or "down").

| Log ratio PMP vs. HV | Target ID | ACCESSION | DEFINITION |
| --- | --- | --- | --- |
| 0.311448435 | HS.580154 | BU753725 (SEQ ID NO: 127) | UI-1-BB1p-aki-a-08-0-UI.s1 NCI_CGAP_Pl6 *Homo sapiens* cDNA clone UI-1-BB1p-aki-a-08-0-UI 3, mRNA sequence |
| 0.311068769 | LOC642726 | XM_931518.1 (SEQ ID NO: 128) | PREDICTED: *Homo sapiens* hypothetical protein LOC642725, transcript variant 1 (LOC642726), mRNA. |
| 0.311047839 | HS.582893 | DB338252 (SEQ ID NO: 129) | DB338252 TESTI2 *Homo sapiens* cDNA clone TESTI2035277 3, mRNA sequence |
| 0.311027043 | DSCC1 | NM_024094.1 (SEQ ID NO: 130) | *Homo sapiens* defective in sister chromatid cohesion 1 homolog (*S. cerevisiae*) (DSCC1), mRNA. |
| 0.309461784 | FLJ42258 | NM_001004327.1 (SEQ ID NO: 131) | *Homo sapiens* FLJ42258 protein (FLJ42258), mRNA. |
| 0.306433774 | HS.327917 | BX111675 (SEQ ID NO: 132) | BX111675 NCI_CGAP_Kid11 *Homo sapiens* cDNA clone IMAGp998C235337, mRNA sequence |
| 0.304704054 | HS.574278 | DA608330 (SEQ ID NO: 133) | DA608330 IMR322 *Homo sapiens* cDNA clone IMR322005706 5, mRNA sequence |
| 0.302132161 | IRAK3 | NM_007199.1 (SEQ ID NO: 134) | *Homo sapiens* interleukin-1 receptor-associated kinase 3 (IRAK3), mRNA. |
| 0.301644841 | HS.128892 | BX099310 (SEQ ID NO: 135) | BX099310 Soares_NFL_T_GBC_S1 *Homo sapiens* cDNA clone IMAGp998P164537, mRNA sequence |
| 0.301562862 | HS.572999 | BX111671 (SEQ ID NO: 136) | BX111671 NCI_CGAP_Pr28 *Homo sapiens* cDNA clone IMAGp998C205228, mRNA sequence |
| 0.301556094 | LOC100129410 | XM_001715712.1 (SEQ ID NO: 137) | PREDICTED: *Homo sapiens* hypothetical protein LOC100129410 (LOC100129410), mRNA. |
| 0.301456066 | HS.407666 | XM_373771 (SEQ ID NO: 138) | PREDICTED: *Homo sapiens* hypothetical LOC388456 (LOC388456), mRNA |
| 0.300764264 | HS.544721 | AI188195 (SEQ ID NO: 139) | qd66f02.x1 Soares_testis_NHT *Homo sapiens* cDNA clone IMAGE: 1734459 3, mRNA sequence |
| 0.29875399 | HS.333785 | BG196443 (SEQ ID NO: 140) | RST15665 Athersys RAGE Library *Homo sapiens* cDNA, mRNA sequence |
| 0.298401615 | HS.527174 | CF887416 (SEQ ID NO: 141) | UI-CF-FN0-afv-p-23-18-UI.r18 UI-CF-FN0 *Homo sapiens* cDNA clone UI-CF-FN0-afv-p-23-18-UI 5, mRNA sequence |
| 0.297928336 | HS.562263 | BM704202 (SEQ ID NO: 142) | UI-E-CK1-afj-m-16-0-UI.r1 UI-E-CK1 *Homo sapiens* cDNA clone UI-E-CK1-afj-m-16-0-UI 5, mRNA sequence |
| 0.296478585 | HS.542905 | AA400272 (SEQ ID NO: 143) | zu63c05.s1 Soares_testis_NHT *Homo sapiens* cDNA clone IMAGE: 742664 3, mRNA sequence |
| 0.296180415 | LOC643894 | XM_001721898.1 (SEQ ID NO: 144) | PREDICTED: *Homo sapiens* similar to hCG1744064 (LOC643894), mRNA. |
| 0.295414166 | HS.543987 | AI433683 (SEQ ID NO: 145) | ti88c09.x1 NCI_CGAP_Kid11 *Homo sapiens* cDNA clone IMAGE: 2139088 3, mRNA sequence |
| 0.294799162 | EGOT | NR_004428.1 (SEQ ID NO: 146) | *Homo sapiens* eosinophil granule ontogeny transcript (non-protein coding) (EGOT), non-coding RNA. |
| 0.294555566 | HS.569953 | BI047056 (SEQ ID NO: 147) | MR3-FN0206-070201-014-b05 FN0206 *Homo sapiens* cDNA, mRNA sequence |
| 0.292269527 | HS.539683 | AW270402 (SEQ ID NO: 148) | xp75b08.x1 NCI_CGAP_Ov40 *Homo sapiens* cDNA clone IMAGE: 2746167 3, mRNA sequence |
| 0.291783226 | LOC100131510 | XR_038622.1 (SEQ ID NO: 149) | PREDICTED: *Homo sapiens* misc_RNA (LOC100131510), miscRNA. |
| 0.291230816 | RAB13 | NM_002870.2 (SEQ ID NO: 150) | *Homo sapiens* RAB13, member RAS oncogene family (RAB13), mRNA. |
| 0.288870205 | CPN2 | XM_942072.2 (SEQ ID NO: 151) | PREDICTED: *Homo sapiens* carboxypeptidase N, polypeptide 2, 83 kD (CPN2), mRNA. |

TABLE I-continued

List of target genes identified by Illumina analysis, together with an indication whether they are up-regulated (positive log ratio or "up") or down-regulated (negative log ratio or "down").

| Log ratio PMP vs. HV | Target ID | ACCESSION | DEFINITION |
|---|---|---|---|
| 0.288688866 | SEPHS2 | NM_012248.2 (SEQ ID NO: 152) | *Homo sapiens* selenophosphate synthetase 2 (SEPHS2), mRNA. |
| 0.288555167 | HS.114286 | AK025016 (SEQ ID NO: 153) | *Homo sapiens* cDNA: FLJ21363 fis, clone COL02986 |
| 0.288413753 | RAD54L2 | NM_015106.2 (SEQ ID NO: 154) | *Homo sapiens* RAD54-like 2 (*S. cerevisiae*) (RAD54L2), mRNA. |
| 0.287614431 | HS.560319 | BC032017 (SEQ ID NO: 155) | *Homo sapiens* cDNA clone IMAGE: 4825254 |
| 0.287002847 | SC65 | NM_006455.2 (SEQ ID NO: 156) | *Homo sapiens* synaptonemal complex protein SC65 (SC65), mRNA. |
| 0.286361546 | HS.571435 | AW188305 (SEQ ID NO: 157) | xj95a05.x1 Soares_NFL_T_GBC_S1 *Homo sapiens* cDNA clone IMAGE: 2664944 3, mRNA sequence |
| 0.286179027 | HS.553290 | CX787363 (SEQ ID NO: 158) | HESC3_84_D06.g1_A036 Human embryonic stem cells *Homo sapiens* cDNA clone IMAGE: 7483454 5, mRNA sequence |
| 0.285480835 | HS.545074 | AA503583 (SEQ ID NO: 159) | ng07e12.s1 NCI_CGAP_Li1 *Homo sapiens* cDNA clone IMAGE: 928750, mRNA sequence |
| 0.283982665 | LOC648370 | XM_937423.1 (SEQ ID NO: 160) | PREDICTED: *Homo sapiens* hypothetical protein LOC648370 (LOC648370), mRNA. |
| 0.282655174 | HS.571223 | BX119501 (SEQ ID NO: 161) | BX119501 Soares_pregnant_uterus_NbHPU *Homo sapiens* cDNA clone IMAGp998A084374; IMAGE: 1721743, mRNA sequence |
| 0.280489734 | HS.211821 | BX090817 (SEQ ID NO: 162) | BX090817 NCI_CGAP_Brn52 *Homo sapiens* cDNA clone IMAGp998G155675; IMAGE: 2290982, mRNA sequence |
| 0.280225376 | HS.547858 | BG188175 (SEQ ID NO: 163) | RST7186 Athersys RAGE Library *Homo sapiens* cDNA, mRNA sequence |
| 0.278453065 | PSMC3IP | NM_013290.5 (SEQ ID NO: 164) | *Homo sapiens* PSMC3 interacting protein (PSMC3IP), transcript variant 1, mRNA. |
| 0.277366844 | HS.438979 | XM_374169 (SEQ ID NO: 165) | PREDICTED: *Homo sapiens* hypothetical LOC389393 (LOC389393), mRNA |
| 0.276716928 | HUS1B | NM_148959.3 (SEQ ID NO: 166) | *Homo sapiens* HUS1 checkpoint homolog b (*S. pombe*) (HUS1B), mRNA. |
| 0.276384381 | LOC100129906 | XM_001714161.1 (SEQ ID NO: 167) | PREDICTED: *Homo sapiens* hypothetical protein LOC100129906 (LOC100129906), mRNA. |
| 0.275958037 | LOC100129699 | XM_001718711.1 (SEQ ID NO: 168) | PREDICTED: *Homo sapiens* similar to hCG2023449 (LOC100129699), mRNA. |
| 0.275043965 | LOC100132894 | XM_001721411.1 (SEQ ID NO: 169) | PREDICTED: *Homo sapiens* hypothetical protein LOC100132894, transcript variant 1 (LOC100132894), mRNA. |
| 0.274523733 | FBXO42 | NM_018994.1 (SEQ ID NO: 170) | *Homo sapiens* F-box protein 42 (FBXO42), mRNA. |
| 0.274083105 | PRR3 | NM_001077497.1 (SEQ ID NO: 171) | *Homo sapiens* proline rich 3 (PRR3), transcript variant 2, mRNA. |
| 0.273505908 | NPR1 | NM_000906.2 (SEQ ID NO: 172) | *Homo sapiens* natriuretic peptide receptor A/guanylate cyclase A (atrionatriuretic peptide receptor A) (NPR1), mRNA. |
| 0.272398708 | HS.90221 | AK095804 (SEQ ID NO: 173) | *Homo sapiens* cDNA FLJ38485 fis, clone FEBRA2023285 |
| 0.272299598 | HS.523235 | AA639731 (SEQ ID NO: 174) | nq82a06.s1 NCI_CGAP_Co9 *Homo sapiens* cDNA clone IMAGE: 1158802 3, mRNA sequence |
| 0.271246232 | CYTH3 | NM_004227.3 (SEQ ID NO: 175) | *Homo sapiens* cytohesin 3 (CYTH3), mRNA. |
| 0.271094707 | LOC646990 | XM_929962.1 (SEQ ID NO: 176) | PREDICTED: *Homo sapiens* hypothetical protein LOC646990 (LOC646990), mRNA. |

TABLE I-continued

List of target genes identified by Illumina analysis, together with an
indication whether they are up-regulated (positive log ratio or "up") or
down-regulated (negative log ratio or "down").

| Log ratio PMP vs. HV | Target ID | ACCESSION | DEFINITION |
|---|---|---|---|
| 0.270098342 | PDCD11 | NM_014976.1 (SEQ ID NO: 177) | *Homo sapiens* programmed cell death 11 (PDCD11), mRNA. |
| 0.270039678 | HS.543063 | CD245475 (SEQ ID NO: 178) | AGENCOURT_14128120 NIH_MGC_181 *Homo sapiens* cDNA clone IMAGE: 30374198 5, mRNA sequence |
| 0.267719251 | HS.553278 | BX108660 (SEQ ID NO: 179) | BX108660 Soares_NFL_T_GBC_S1 *Homo sapiens* cDNA clone IMAGp998K174517, mRNA sequence |
| 0.267678157 | BACH1 | NM_001011545.1 (SEQ ID NO: 180) | *Homo sapiens* BTB and CNC homology 1, basic leucine zipper transcription factor 1 (BACH1), transcript variant 3, mRNA. |
| 0.267591499 | TESSP5 | NM_199183.1 (SEQ ID NO: 181) | *Homo sapiens* testis serine protease 5 (TESSP5), mRNA. |
| 0.265819463 | HS.566643 | AW135243 (SEQ ID NO: 182) | UI-H-BI1-ach-b-04-0-UI.s1 NCI_CGAP_Sub3 *Homo sapiens* cDNA clone IMAGE: 2714071 3, mRNA sequence |
| 0.264864487 | HS.547293 | BE326664 (SEQ ID NO: 183) | hr63a10.x1 NCI_CGAP_Kid11 *Homo sapiens* cDNA clone IMAGE: 3133146 3 similar to contains MER22.t1 MER22 repetitive element;, mRNA sequence |
| 0.264640482 | LOC283849 | NM_178516.2 (SEQ ID NO: 184) | *Homo sapiens* hypothetical protein LOC283849 (LOC283849), mRNA. |
| 0.2643875 | HS.336643 | CB052724 (SEQ ID NO: 185) | NISC_gl09g03.y1 NCI_CGAP_Lei2 *Homo sapiens* cDNA clone IMAGE: 3290668 5, mRNA sequence |
| 0.264290553 | MORG1 | NM_032332.2 (SEQ ID NO: 186) | *Homo sapiens* mitogen-activated protein kinase organizer 1 (MORG1), mRNA. |
| 0.263875482 | STX4 | NM_004604.3 (SEQ ID NO: 187) | *Homo sapiens* syntaxin 4 (STX4), mRNA. |
| 0.263609738 | HS.505398 | AI971548 (SEQ ID NO: 188) | wq87c02.x1 NCI_CGAP_GC6 *Homo sapiens* cDNA clone IMAGE: 2479010 3, mRNA sequence |
| 0.262729627 | PDCD10 | NM_007217.3 (SEQ ID NO: 189) | *Homo sapiens* programmed cell death 10 (PDCD10), transcript variant 1, mRNA. |
| 0.262668794 | HS.450769 | BM850770 (SEQ ID NO: 190) | K-EST0131410 S21SNU520 *Homo sapiens* cDNA clone S21SNU520-49-E06 5, mRNA sequence |
| 0.262479539 | HS.143937 | CK001807 (SEQ ID NO: 191) | AGENCOURT_16379396 NIH_MGC_227 *Homo sapiens* cDNA clone IMAGE: 30717931 5, mRNA sequence |
| 0.262271327 | LOC653878 | XM_936223.1 (SEQ ID NO: 192) | PREDICTED: *Homo sapiens* similar to Cytosolic acyl coenzyme A thioester hydrolase, inducible (Long chain acyl-CoA thioester hydrolase) (Long chain acyl-CoA hydrolase) (CTE-I) (CTE-Ib) (LOC653878), mRNA. |
| 0.261424332 | LOC100130071 | XM_001716832.1 (SEQ ID NO: 193) | PREDICTED: *Homo sapiens* similar to GSQS6193 (LOC100130071), mRNA. |
| 0.261375961 | HS.539841 | AA744242 (SEQ ID NO: 194) | ny62f03.s1 NCI_CGAP_GCB1 *Homo sapiens* cDNA clone IMAGE: 1282877 3, mRNA sequence |
| 0.261186788 | SIPA1L1 | NM_015556.1 (SEQ ID NO: 195) | *Homo sapiens* signal-induced proliferation-associated 1 like 1 (SIPA1L1), mRNA. |
| 0.260256467 | HS.374420 | CR613022 (SEQ ID NO: 196) | full-length cDNA clone CS0CAP006YG05 of Thymus of *Homo sapiens* (human) |
| 0.260027372 | HS.545626 | CD245737 (SEQ ID NO: 197) | AGENCOURT_14098047 NIH_MGC_181 *Homo sapiens* cDNA clone IMAGE: 30376866 5, mRNA sequence |
| 0.259158846 | SPEF2 | NM_024867.3 (SEQ ID NO: 198) | *Homo sapiens* sperm flagellar 2 (SPEF2), transcript variant 1, mRNA. |
| 0.258711041 | HS.541757 | CD518786 (SEQ ID NO: 199) | AGENCOURT_14375962 NIH_MGC_181 *Homo sapiens* cDNA clone IMAGE: 30408978 5, mRNA sequence |

TABLE I-continued

List of target genes identified by Illumina analysis, together with an
indication whether they are up-regulated (positive log ratio or "up") or
down-regulated (negative log ratio or "down").

| Log ratio PMP vs. HV | Target ID | ACCESSION | DEFINITION |
|---|---|---|---|
| 0.258540094 | C1RL | NM_016546.1 (SEQ ID NO: 200) | *Homo sapiens* complement component 1, r subcomponent-like (C1RL), mRNA. |
| 0.258216828 | LOC729157 | XR_015862.1 (SEQ ID NO: 201) | PREDICTED: *Homo sapiens* mist_RNA (LOC729157), miscRNA. |
| 0.257210595 | HS.436627 | AK123174 (SEQ ID NO: 202) | *Homo sapiens* cDNA FLJ41179 fis, clone BRACE2043036 |
| 0.2564511 | HS.377419 | AA532810 (SEQ ID NO: 203) | nf71b03.s1 NCI_CGAP_Co3 *Homo sapiens* cDNA clone IMAGE: 925325 3, mRNA sequence |
| 0.255597686 | UTRN | NM_007124.2 (SEQ ID NO: 204) | *Homo sapiens* utrophin (UTRN), mRNA. |
| 0.255569381 | HS.580802 | DA083801 (SEQ ID NO: 205) | DA083801 BRACE2 *Homo sapiens* cDNA clone BRACE2037735 5, mRNA sequence |
| 0.254989883 | LOC650698 | XM_939784.1 (SEQ ID NO: 206) | PREDICTED: *Homo sapiens* similar to SH3/ankyrin domain gene 2 isoform a (LOC650698), mRNA. |
| 0.254785157 | HS.560987 | BU753119 (SEQ ID NO: 207) | UI-1-BB1-aii-h-04-0-UI.s1 NCI_CGAP_P15 *Homo sapiens* cDNA clone UI-1-BB1-aii-h-04-0-UI 3, mRNA sequence |
| 0.254459099 | HS.564967 | AA725682 (SEQ ID NO: 208) | ai19g05.s1 Soares_testis_NHT *Homo sapiens* cDNA clone 1343288 3, mRNA sequence |
| 0.254027524 | SYN2 | NM_003178.4 (SEQ ID NO: 209) | *Homo sapiens* synapsin II (SYN2), transcript variant IIb, mRNA. |
| 0.253773675 | HS.553310 | CA425772 (SEQ ID NO: 210) | UI-H-FE1-beg-g-15-0-UI.s1 NCI_CGAP_FE1 *Homo sapiens* cDNA clone UI-H-FE1-beg-g-15-0-UI 3, mRNA sequence |
| 0.253749524 | LOC651296 | XM_940424.1 (SEQ ID NO: 211) | PREDICTED: *Homo sapiens* similar to RAB, member of RAS oncogene family-like 2B isoform 1 (LOC651296), mRNA. |
| 0.252066449 | HS.543875 | AL049310 (SEQ ID NO: 212) | *Homo sapiens* mRNA; cDNA DKFZp564B206 (from clone DKFZp564B206) |
| 0.251815933 | HS.580058 | AI075708 (SEQ ID NO: 213) | oz24f08.x1 Soares_total_fetus_Nb2HF8_9w *Homo sapiens* cDNA clone IMAGE: 1676295 3, mRNA sequence |
| 0.250190992 | LOC100128695 | XM_001715889.1 (SEQ ID NO: 214) | PREDICTED: *Homo sapiens* hypothetical LOC100128695 (LOC100128695), mRNA. |
| 0.250021556 | HS.148448 | AI798899 (SEQ ID NO: 215) | we94a12.x1 Soares_NFL_T_GBC_S1 *Homo sapiens* cDNA clone IMAGE: 2348734 3, mRNA sequence |
| 0.249834606 | HS.528284 | AW855473 (SEQ ID NO: 216) | CM0-CT0275-221199-105-c11 CT0275 *Homo sapiens* cDNA, mRNA sequence |
| 0.248944004 | HS.542632 | U03241 (SEQ ID NO: 217) | Human clone pLSB8 chromosome 21 STS |
| 0.24758826 | HS.528210 | CK299576 (SEQ ID NO: 218) | UI-E-EJ1-ajv-n-10-0-UI.s1 UI-E-EJ1 *Homo sapiens* cDNA clone UI-E-EJ1-ajv-n-10-0-UI 3, mRNA sequence |
| 0.247471154 | LOC100129147 | XM_001725523.1 (SEQ ID NO: 219) | PREDICTED: *Homo sapiens* hypothetical protein LOC100129147 (LOC100129147), mRNA. |
| 0.24678226 | C10ORF28 | NM_014472.3 (SEQ ID NO: 220) | *Homo sapiens* chromosome 10 open reading frame 28 (C10orf28), mRNA. |
| 0.246324365 | HS.559981 | BQ023418 (SEQ ID NO: 221) | UI-1-BB1p-avd-b-12-0-UI.s1 NCI_CGAP_P16 *Homo sapiens* cDNA clone UI-1-BB1p-avd-b-12-0-UI 3, mRNA sequence |
| 0.246203021 | PRAMEF7 | NM_001012277.1 (SEQ ID NO: 222) | *Homo sapiens* PRAME family member 7 (PRAMEF7), mRNA. |
| 0.246120402 | HS.537754 | AW084405 (SEQ ID NO: 223) | xc56f12.x1 NCI_CGAP_Eso2 *Homo sapiens* cDNA clone IMAGE: 2588303 3, mRNA sequence |
| 0.245977154 | HS.537638 | AI610323 (SEQ ID NO: 224) | tp40c11.x1 NCI_CGAP_Ut4 *Homo sapiens* cDNA clone IMAGE: 2190260 3, mRNA sequence |
| 0.245420915 | ANO9 | NM_001012302.2 (SEQ ID NO: 225) | *Homo sapiens* anoctamin 9 (ANO9), mRNA. |

TABLE I-continued

List of target genes identified by Illumina analysis, together with an indication whether they are up-regulated (positive log ratio or "up") or down-regulated (negative log ratio or "down").

| Log ratio PMP vs. HV | Target ID | ACCESSION | DEFINITION |
|---|---|---|---|
| 0.243992548 | HS.344350 | BI603074 (SEQ ID NO: 226) | 603251294F1 NIH_MGC_96 Homo sapiens cDNA clone IMAGE: 5303182 5, mRNA sequence |
| 0.243782267 | LOC647306 | XM_930375.1 (SEQ ID NO: 227) | PREDICTED: Homo sapiens hypothetical protein LOC647306 (LOC647306), mRNA. |
| 0.24346891 | CLEC18C | NM_173619.2 (SEQ ID NO: 228) | Homo sapiens C-type lectin domain family 18, member C (CLEC18C), mRNA. |
| 0.242802997 | HS.567436 | AK026725 (SEQ ID NO: 229) | Homo sapiens cDNA: FLJ23072 fis, clone LNG05713 |
| 0.24234321 | HS.445121 | BM545878 (SEQ ID NO: 230) | AGENCOURT_6505119 NIH_MGC_125 Homo sapiens cDNA clone IMAGE: 5588241 5, mRNA sequence |
| 0.242269316 | MSTO2P | NR_024117.1 (SEQ ID NO: 231) | Homo sapiens misato homolog 2 pseudogene (MSTO2P), non-coding RNA. |
| 0.242200556 | LOC440459 | XR_019054.1 (SEQ ID NO: 232) | PREDICTED: Homo sapiens similar to solute carrier family 16, member 6 (LOC440459), miscRNA. |
| 0.241893622 | ATF6 | NM_007348.2 (SEQ ID NO: 233) | Homo sapiens activating transcription factor 6 (ATF6), mRNA. |
| 0.241621226 | LOC644641 | XM_929614.1 (SEQ ID NO: 234) | PREDICTED: Homo sapiens hypothetical protein LOC644641 (LOC644641), mRNA. |
| 0.24116816 | LOC100128392 | XM_001723572.1 (SEQ ID NO: 235) | PREDICTED: Homo sapiens hypothetical LOC100128392 (LOC100128392), mRNA. |
| 0.240685997 | LOC100133264 | XM_001715579.1 (SEQ ID NO: 236) | PREDICTED: Homo sapiens hypothetical protein LOC100133264 (LOC100133264), mRNA. |
| 0.24037929 | TP53I3 | NM_004881.2 (SEQ ID NO: 237) | Homo sapiens tumor protein p53 inducible protein 3 (TP53I3), transcript variant 1, mRNA. |
| 0.239850463 | LOC100132474 | XM_001726593.1 (SEQ ID NO: 238) | PREDICTED: Homo sapiens hypothetical protein LOC100132474 (LOC100132474), mRNA. |
| 0.239755403 | HDAC9 | NM_058176.2 (SEQ ID NO: 239) | Homo sapiens histone deacetylase 9 (HDAC9), transcript variant 1, mRNA. |
| 0.239483218 | HS.245812 | AW130132 (SEQ ID NO: 240) | xf28f11.x1 NCI_CGAP_Ut1 Homo sapiens cDNA clone IMAGE: 2619405 3, mRNA sequence |
| 0.238382177 | SLC26A8 | NM_138718.1 (SEQ ID NO: 241) | Homo sapiens solute carrier family 26, member 8 (SLC26A8), transcript variant 2, mRNA. |
| 0.236865978 | LOC100132485 | XM_001720394.1 (SEQ ID NO: 242) | PREDICTED: Homo sapiens hypothetical protein LOC100132485 (LOC100132485), mRNA. |
| 0.236227448 | RBM11 | NM_144770.2 (SEQ ID NO: 243) | Homo sapiens RNA binding motif protein 11 (RBM11), mRNA. |
| 0.235733066 | SLC38A5 | NM_033518.1 (SEQ ID NO: 244) | Homo sapiens solute carrier family 38, member 5 (SLC38A5), mRNA. |
| 0.235692267 | HS.571403 | DA453004 (SEQ ID NO: 245) | DA453004 CTONG2 Homo sapiens cDNA clone CTONG2025812 5, mRNA sequence |
| 0.235571445 | HS.575615 | BG437415 (SEQ ID NO: 246) | 602490627F1 NIH_MGC_18 Homo sapiens cDNA clone IMAGE: 4622599 5, mRNA sequence |
| 0.235449061 | CBY3 | XM_928982.3 (SEQ ID NO: 247) | PREDICTED: Homo sapiens chibby homolog 3 (Drosophila) (CBY3), mRNA. |
| 0.235031428 | KLF3 | NM_016531.4 (SEQ ID NO: 248) | Homo sapiens Kruppel-like factor 3 (basic) (KLF3), mRNA. |
| 0.234461498 | EDG1 | NM_001400.3 (SEQ ID NO: 249) | Homo sapiens endothelial differentiation, sphingolipid G-protein-coupled receptor, 1 (EDG1), mRNA. |
| 0.233892907 | HS.576822 | DB337826 (SEQ ID NO: 250) | DB337826 TESTI2 Homo sapiens cDNA clone TESTI2027763 3, mRNA sequence |
| 0.233364677 | TSLP | NM_138551.2 (SEQ ID NO: 251) | Homo sapiens thymic stromal lymphopoietin (TSLP), transcript variant 2, mRNA. |

TABLE I-continued

List of target genes identified by Illumina analysis, together with an indication whether they are up-regulated (positive log ratio or "up") or down-regulated (negative log ratio or "down").

| Log ratio PMP vs. HV | Target ID | ACCESSION | DEFINITION |
|---|---|---|---|
| 0.233211492 | HS.544326 | AW510984 (SEQ ID NO: 252) | hd38d03.x1 Soares_NFL_T_GBC_S1 Homo sapiens cDNA clone IMAGE: 2911781 3, mRNA sequence |
| 0.232924491 | ZCCHC16 | XM_937313.1 (SEQ ID NO: 253) | PREDICTED: Homo sapiens zinc finger, CCHC domain containing 16 (ZCCHC16), mRNA. |
| 0.232839494 | TFEC | NM_001018058.1 (SEQ ID NO: 254) | Homo sapiens transcription factor EC (TFEC), transcript variant 2, mRNA. |
| 0.232801773 | HS.584251 | DB298233 (SEQ ID NO: 255) | DB298233 BRACE2 Homo sapiens cDNA clone BRACE2044341 3, mRNA sequence |
| 0.232543585 | HS.543175 | BQ448432 (SEQ ID NO: 256) | UI-H-EU1-bag-d-07-0-UI.s1 NCI_CGAP_Ct1 Homo sapiens cDNA clone UI-H-EU1-bag-d-07-0-UI 3, mRNA sequence |
| 0.231261328 | HS.538746 | AW340271 (SEQ ID NO: 257) | hd03d12.x1 Soares_NFL_T_GBC_S1 Homo sapiens cDNA clone IMAGE: 2908439 3, mRNA sequence |
| 0.230871518 | HS.147420 | AI650595 (SEQ ID NO: 258) | wa92h11.x1 NCI_CGAP_GC6 Homo sapiens cDNA clone IMAGE: 2303685 3, mRNA sequence |
| 0.230401752 | HS.541581 | BF589745 (SEQ ID NO: 259) | nac23e12.x1 Lupski_sciatic_nerve Homo sapiens cDNA clone IMAGE: 3394270 3, mRNA sequence |
| 0.229630597 | LOC90342 | XM_937145.1 (SEQ ID NO: 260) | PREDICTED: Homo sapiens similar to fer-1 like protein 3 (LOC90342), mRNA. |
| 0.229423975 | HS.570176 | AK094576 (SEQ ID NO: 261) | Homo sapiens cDNA FLJ37257 fis, clone BRAMY2010171 |
| 0.229243683 | HS.541237 | AF335593 (SEQ ID NO: 262) | Homo sapiens cone rod homeobox protein (CRX) mRNA, 5UTR, alternatively spliced |
| 0.229216581 | QSER1 | NM_001076786.1 (SEQ ID NO: 263) | Homo sapiens glutamine and serine rich 1 (QSER1), mRNA. |
| 0.228990838 | LOC646278 | XR_042488.1 (SEQ ID NO: 264) | PREDICTED: Homo sapiens similar to programmed cell death 6 interacting protein (LOC646278), miscRNA. |
| 0.227506 | PKLR | NM_181871.2 (SEQ ID NO: 265) | Homo sapiens pyruvate kinase, liver and RBC (PKLR), nuclear gene encoding mitochondrial protein, transcript variant 2, mRNA. |
| 0.227138335 | HS.578117 | BQ011293 (SEQ ID NO: 266) | UI-1-BC1p-ary-b-02-0-UI.s1 NCI_CGAP_P13 Homo sapiens cDNA clone UI-1-BC1p-ary-b-02-0-UI 3, mRNA sequence |
| 0.226996944 | LOC641798 | XM_935965.1 (SEQ ID NO: 267) | PREDICTED: Homo sapiens hypothetical protein LOC641797, transcript variant 1 (LOC641798), mRNA. |
| 0.22641664 | LOC652993 | XR_018000.1 (SEQ ID NO: 268) | PREDICTED: Homo sapiens hypothetical LOC652993 (LOC652993), miscRNA. |
| 0.226005539 | HS.547587 | AV650212 (SEQ ID NO: 269) | AV650212 GLC Homo sapiens cDNA clone GLCCCD12 3, mRNA sequence |
| 0.224516705 | HS.127874 | AI809077 (SEQ ID NO: 270) | wf68b04.x1 Soares_NFL_T_GBC_S1 Homo sapiens cDNA clone IMAGE: 2360719 3, mRNA sequence |
| 0.224313066 | HS.537451 | BU167332 (SEQ ID NO: 271) | AGENCOURT_7971794 NIH_MGC_67 Homo sapiens cDNA clone IMAGE: 6169756 5, mRNA sequence |
| 0.223606485 | HS.262789 | AW300868 (SEQ ID NO: 272) | xk07d09.x1 NCI_CGAP_Co20 Homo sapiens cDNA clone IMAGE: 2666033 3, mRNA sequence |
| 0.223004172 | LOC100133200 | XR_038343.1 (SEQ ID NO: 273) | PREDICTED: Homo sapiens misc_RNA (LOC100133200), miscRNA. |
| 0.222575995 | HS.97549 | BX093254 (SEQ ID NO: 274) | BX093254 Soares_testis_NHT Homo sapiens cDNA clone IMAGp998H181789; IMAGE: 729281, mRNA sequence |

TABLE I-continued

List of target genes identified by Illumina analysis, together with an
indication whether they are up-regulated (positive log ratio or "up") or
down-regulated (negative log ratio or "down").

| Log ratio PMP vs. HV | Target ID | ACCESSION | DEFINITION |
|---|---|---|---|
| 0.222292592 | LOC391429 | XM_372954.1 (SEQ ID NO: 275) | PREDICTED: *Homo sapiens* hypothetical LOC391429 (LOC391429), mRNA. |
| 0.222241502 | ATL1 | NM_015915.4 (SEQ ID NO: 276) | *Homo sapiens* atlastin GTPase 1 (ATL1), transcript variant 1, mRNA. |
| 0.222222163 | TMEM151 | XM_001133285.1 (SEQ ID NO: 277) | PREDICTED: *Homo sapiens* transmembrane protein 151 (TMEM151), mRNA. |
| 0.221724233 | HS.537742 | AA609391 (SEQ ID NO: 278) | zu71h01.s1 Soares_testis_NHT *Homo sapiens* cDNA clone IMAGE: 743473 3, mRNA sequence |
| 0.219779366 | HS.320051 | AK093987 (SEQ ID NO: 279) | *Homo sapiens* cDNA FLJ36668 fis, clone UTERU2003926 |
| 0.219380271 | LOC100128300 | XM_001725044.1 (SEQ ID NO: 280) | PREDICTED: *Homo sapiens* hypothetical protein LOC100128300 (LOC100128300), mRNA. |
| 0.219225941 | TNXA | NR_001284.1 (SEQ ID NO: 281) | *Homo sapiens* tenascin XA pseudogene (TNXA) on chromosome 6. |
| 0.21844383 | HS.282153 | BE501770 (SEQ ID NO: 282) | hw34h12.x1 NCI_CGAP_Kid11 *Homo sapiens* cDNA clone IMAGE: 3184871 3, mRNA sequence |
| 0.218362538 | HS.572883 | BF433017 (SEQ ID NO: 283) | 7n23g07.x1 NCI_CGAP_Lu24 *Homo sapiens* cDNA clone IMAGE: 3565621 3, mRNA sequence |
| 0.218321837 | KLHL33 | XM_001714708.1 (SEQ ID NO: 284) | PREDICTED: *Homo sapiens* kelch-like 33 (*Drosophila*) (KLHL33), mRNA. |
| 0.217734316 | FLJ45202 | NM_207507.1 (SEQ ID NO: 285) | *Homo sapiens* FLJ45202 protein (FLJ45202), mRNA. |
| 0.216472558 | HS.513842 | BM702416 (SEQ ID NO: 286) | UI-E-CQ1-aez-e-05-0-UI.r1 UI-E-CQ1 *Homo sapiens* cDNA clone UI-E-CQ1-aez-e-05-0-UI 5, mRNA sequence |
| 0.216448205 | LOC100133758 | XM_001719929.1 (SEQ ID NO: 287) | PREDICTED: *Homo sapiens* hypothetical LOC100133758 (LOC100133758), partial mRNA. |
| 0.216376703 | HS.436654 | BM673750 (SEQ ID NO: 288) | UI-E-EJ0-ahh-i-07-0-UI.s1 UI-E-EJ0-*Homo sapiens* cDNA clone UI-E-EJ0-ahh-i-07-0-UI 3, mRNA sequence |
| 0.215770924 | LOC730254 | XM_001134396.1 (SEQ ID NO: 289) | PREDICTED: *Homo sapiens* hypothetical LOC730254 (LOC730254), mRNA. |
| 0.215582349 | HS.371789 | AI695926 (SEQ ID NO: 290) | ts87f05.x1 NCI_CGAP_GC6 *Homo sapiens* cDNA clone IMAGE: 2238273 3, mRNA sequence |
| 0.215499493 | USP43 | NM_153210.2 (SEQ ID NO: 291) | *Homo sapiens* ubiquitin-specific peptidase 43 (USP43), mRNA. |
| 0.215243577 | ACER2 | NM_001010887.2 (SEQ ID NO: 292) | *Homo sapiens* alkaline ceramidase 2 (ACER2), mRNA. |
| 0.21259369 | HS.547601 | AF086087 (SEQ ID NO: 293) | *Homo sapiens* full length insert cDNA clone YZ84G08 |
| 0.211853505 | XAGE1E | NM_001097604.1 (SEQ ID NO: 294) | *Homo sapiens* X antigen family, member 1E (XAGE1E), transcript variant 2, mRNA. |
| 0.211840181 | LOC439950 | XR_040718.1 (SEQ ID NO: 295) | PREDICTED: *Homo sapiens* misc_RNA (LOC439950), miscRNA. |
| 0.211785217 | HS.514440 | AW440458 (SEQ ID NO: 296) | xt14e05.x1 NCI_CGAP_Ut4 *Homo sapiens* cDNA clone IMAGE: 2779136 3, mRNA sequence |
| 0.211422576 | HS.539450 | AA810581 (SEQ ID NO: 297) | oa85h04.s1 NCI_CGAP_GCB1 *Homo sapiens* cDNA clone IMAGE: 1319095 3, mRNA sequence |
| 0.211265945 | HS.566937 | BF509831 (SEQ ID NO: 298) | UI-H-BI4-apc-c-04-0-UI.s1 NCI_CGAP_Sub8 *Homo sapiens* cDNA clone IMAGE: 3086958 3, mRNA sequence |
| 0.210924998 | ZNF155 | NM_003445.2 (SEQ ID NO: 299) | *Homo sapiens* zinc finger protein 155 (ZNF155), transcript variant 1, mRNA. |
| 0.210528175 | HS.566801 | BF514696 (SEQ ID NO: 300) | UI-H-BW1-anh-g-12-0-UI.s1 NCI_CGAP_Sub7 *Homo sapiens* cDNA clone IMAGE: 3082558 3, mRNA sequence |
| 0.209096858 | HS.539384 | AI733668 (SEQ ID NO: 301) | ov06f07.x5 NCI_CGAP_Kid3 *Homo sapiens* cDNA clone IMAGE: 1636549 3, mRNA sequence |

TABLE I-continued

List of target genes identified by Illumina analysis, together with an
indication whether they are up-regulated (positive log ratio or "up") or
down-regulated (negative log ratio or "down").

| Log ratio PMP vs. HV | Target ID | ACCESSION | DEFINITION |
|---|---|---|---|
| 0.209048271 | LOC100128675 | NR_024562.1 (SEQ ID NO: 302) | *Homo sapiens* hypothetical LOC100128675 (LOC100128675), transcript variant 2, non-coding RNA. |
| 0.207726738 | HS.543828 | BE646122 (SEQ ID NO: 303) | 7e81f05.x1 NCI_CGAP_Pr28 *Homo sapiens* cDNA clone IMAGE: 3288897 3, mRNA sequence |
| 0.207339851 | LOC151300 | NR_015390.1 (SEQ ID NO: 304) | *Homo sapiens* hypothetical LOC151300 (LOC151300), transcript variant 2, non-coding RNA. |
| 0.20716108 | LOC441179 | XR_017855.1 (SEQ ID NO: 305) | PREDICTED: *Homo sapiens* hypothetical gene supported by AK055887; AK125190 (LOC441179), misc RNA. |
| 0.206908794 | KCNN3 | NM_002249.4 (SEQ ID NO: 306) | *Homo sapiens* potassium intermediate/small conductance calcium-activated channel, subfamily N, member 3 (KCNN3), transcript variant 1, mRNA. |
| 0.206836678 | CCR9 | NM_031200.1 (SEQ ID NO: 307) | *Homo sapiens* chemokine (C-C motif) receptor 9 (CCR9), transcript variant A, mRNA. |
| 0.20675256 | HS.581662 | BF514549 (SEQ ID NO: 308) | UI-H-BW1-ang-b-09-0-UI.s1 NCI_CGAP_Sub7 *Homo sapiens* cDNA clone IMAGE: 3081953 3, mRNA sequence |
| 0.206187298 | HS.438365 | BX105017 (SEQ ID NO: 309) | BX105017 Soares_fetal_heart_NbHH19W *Homo sapiens* cDNA clone IMAGp998A20842, mRNA sequence |
| 0.205884997 | PROP1 | NM_006261.2 (SEQ ID NO: 310) | *Homo sapiens* PROP paired-like homeobox 1 (PROP1), mRNA. |
| 0.205797283 | GM127 | XM_938555.1 (SEQ ID NO: 311) | PREDICTED: *Homo sapiens* similar to RIKEN 2610020C11 (gm127), mRNA. |
| 0.204046436 | LOC100128918 | XM_001718466.1 (SEQ ID NO: 312) | PREDICTED: *Homo sapiens* hypothetical protein LOC100128918 (LOC100128918), mRNA. |
| 0.20382379 | PTK9 | NM_198974.1 (SEQ ID NO: 313) | *Homo sapiens* PTK9 protein tyrosine kinase 9 (PTK9), transcript variant 2, mRNA. |
| 0.203738347 | LOC644763 | XM_927860.1 (SEQ ID NO: 314) | PREDICTED: *Homo sapiens* similar to erythrocyte membrane protein band 4.1 like 4B isoform 2 (LOC644763), mRNA. |
| 0.203340973 | OR2W3 | NM_001001957.2 (SEQ ID NO: 315) | *Homo sapiens* olfactory receptor, family 2, subfamily W, member 3 (OR2W3), mRNA. |
| 0.202444303 | HS.534997 | L23402 (SEQ ID NO: 316) | Human (clone Z149) retinal mRNA |
| 0.202329789 | HS.575831 | BF849882 (SEQ ID NO: 317) | PM4-EN0063-151100-002-b09 EN0063 *Homo sapiens* cDNA, mRNA sequence |
| 0.200264582 | HS.580053 | DA724733 (SEQ ID NO: 318) | DA724733 NT2RI3 *Homo sapiens* cDNA clone NT2RI3006220 5, mRNA sequence |
| 0.200160695 | HS.177532 | BX355045 (SEQ ID NO: 319) | BX355045 *Homo sapiens* NEUROBLASTOMA COT 25-NORMALIZED *Homo sapiens* cDNA clone CS0DC029YI23 5-PRIME, mRNA sequence |
| 0.19853518 | LOC649596 | XM_938659.1 (SEQ ID NO: 320) | PREDICTED: *Homo sapiens* similar to zinc finger protein 329 (LOC649596), mRNA. |
| 0.194110351 | LOH12CR1 | NM_058169.2 (SEQ ID NO: 321) | *Homo sapiens* loss of heterozygosity, 12, chromosomal region 1 (LOH12CR1), mRNA. |
| 0.190833594 | LOC642420 | XM_930795.1 (SEQ ID NO: 322) | PREDICTED: *Homo sapiens* hypothetical protein LOC642420 (LOC642420), mRNA. |
| 0.190190067 | HS.560563 | BF510793 (SEQ ID NO: 323) | UI-H-BI4-apo-a-02-0-UI.s1 NCI_CGAP_Sub8 *Homo sapiens* cDNA clone IMAGE: 3088010 3, mRNA sequence |

TABLE I-continued

List of target genes identified by Illumina analysis, together with an indication whether they are up-regulated (positive log ratio or "up") or down-regulated (negative log ratio or "down").

| Log ratio PMP vs. HV | Target ID | ACCESSION | DEFINITION |
|---|---|---|---|
| 0.18973138 | LOC388743 | XM_938885.2 (SEQ ID NO: 324) | PREDICTED: *Homo sapiens* similar to calpain 8, transcript variant 4 (LOC388743), mRNA. |
| 0.185853814 | HS.561542 | AW873324 (SEQ ID NO: 325) | hl92a07.x1 NCI_CGAP_Lu24 *Homo sapiens* cDNA clone IMAGE: 3009396 3, mRNA sequence |
| 0.185133299 | HS.278145 | AW629128 (SEQ ID NO: 326) | hi51d04.x1 Soares_NFL_T_GBC_S1 *Homo sapiens* cDNA clone IMAGE: 2975815 3, mRNA sequence |
| 0.181685962 | CTF1 | NM_001330.2 (SEQ ID NO: 327) | *Homo sapiens* cardiotrophin 1 (CTF1), mRNA. |
| 0.178257498 | HS.563654 | BG201663 (SEQ ID NO: 328) | RST21004 Athersys RAGE Library *Homo sapiens* cDNA, mRNA sequence |
| 0.174248793 | SLC25A26 | NM_001009938.1 (SEQ ID NO: 329) | *Homo sapiens* solute carrier family 25, member 26 (SLC25A26), transcript variant 3, mRNA. |
| 0.172335203 | CNTNAP5 | NM_130773.2 (SEQ ID NO: 330) | *Homo sapiens* contactin associated protein-like 5 (CNTNAP5), mRNA. |
| 0.151445464 | LOC100131972 | XM_001715773.1 (SEQ ID NO: 331) | PREDICTED: *Homo sapiens* hypothetical protein LOC100131972 (LOC100131972), mRNA. |
| -0.260428493 | FAM10A4 | NR_002183.1 (SEQ ID NO: 332) | *Homo sapiens* family with sequence similarity 10, member A4 pseudogene (FAM10A4), non-coding RNA. |
| -0.265794765 | DCTD | NM_001921.2 (SEQ ID NO: 333) | *Homo sapiens* dCMP deaminase (DCTD), transcript variant 2, mRNA. |
| -0.267394612 | HNRNPR | NM_005826.3 (SEQ ID NO: 334) | *Homo sapiens* heterogeneous nuclear ribonucleoprotein R (HNRNPR), transcript variant 2, mRNA. |
| -0.268053209 | SNORD31 | NR_002560.1 (SEQ ID NO: 335) | *Homo sapiens* small nucleolar RNA, C/D box 31 (SNORD31), small nucleolar RNA. |
| -0.270868488 | LOC100130919 | XM_001722872.1 (SEQ ID NO: 336) | PREDICTED: *Homo sapiens* hypothetical protein LOC100130919 (LOC100130919), mRNA. |
| -0.271399854 | GLOD4 | NM_016080.2 (SEQ ID NO: 337) | *Homo sapiens* glyoxalase domain containing 4 (GLOD4), mRNA. |
| -0.272886738 | LOC100128266 | XR_037888.1 (SEQ ID NO: 338) | PREDICTED: *Homo sapiens* misc_RNA (LOC100128266), miscRNA. |
| -0.284403431 | LOC100129697 | XM_001732822.1 (SEQ ID NO: 339) | PREDICTED: *Homo sapiens* hypothetical protein LOC100129697 (LOC100129697), mRNA. |
| -0.295431965 | TMX3 | NM_019022.3 (SEQ ID NO: 340) | *Homo sapiens* thioredoxin-related transmembrane protein 3 (TMX3), mRNA. |
| -0.29953729 | YBX1 | NM_004559.3 (SEQ ID NO: 341) | *Homo sapiens* Y box binding protein 1 (YBX1), mRNA. |
| -0.308386487 | IL18BP | NM_173042.2 (SEQ ID NO: 342) | *Homo sapiens* interleukin 18 binding protein (IL18BP), transcript variant A, mRNA. |
| -0.334319636 | HSP90AB1 | NM_007355.2 (SEQ ID NO: 343) | *Homo sapiens* heat shock protein 90 kDa alpha (cytosolic), class B member 1 (HSP90AB1), mRNA. |
| -0.382917922 | LOC439953 | XR_017375.2 (SEQ ID NO: 344) | PREDICTED: *Homo sapiens* misc_RNA (LOC439953), miscRNA. |
| -0.406810782 | COL9A2 | NM_001852.3 (SEQ ID NO: 345) | *Homo sapiens* collagen, type IX, alpha 2 (COL9A2), mRNA. |
| -0.416050903 | FKBP1A | NM_054014.1 (SEQ ID NO: 346) | *Homo sapiens* FK506 binding protein 1A, 12 kDa (FKBP1A), transcript variant 12A, mRNA. |
| -0.451735283 | HSPA1A | NM_005345.4 (SEQ ID NO: 347) | *Homo sapiens* heat shock 70 kDa protein 1A (HSPA1A), mRNA. |
| -0.452374174 | LOC286157 | XR_038597.1 (SEQ ID NO: 348) | PREDICTED: *Homo sapiens* misc_RNA (LOC286157), miscRNA. |
| -0.454880106 | HNRPA1L-2 | NR_002944.2 (SEQ ID NO: 349) | *Homo sapiens* heterogeneous nuclear ribonucleoprotein A1 pseudogene (HNRPA1L-2), non-coding RNA. |
| -0.506093336 | LOC643873 | XR_039149.1 (SEQ ID NO: 350) | PREDICTED: *Homo sapiens* misc_RNA (LOC643873), miscRNA. |
| -0.525288782 | NBPF14 | NM_015383.1 (SEQ ID NO: 351) | *Homo sapiens* neuroblastoma breakpoint family, member 14 (NBPF14), mRNA. |

TABLE I-continued

List of target genes identified by Illumina analysis, together with an indication whether they are up-regulated (positive log ratio or "up") or down-regulated (negative log ratio or "down").

| Log ratio PMP vs. HV | Target ID | ACCESSION | DEFINITION |
|---|---|---|---|
| −0.525590589 | LOC643287 | XM_928075.2 (SEQ ID NO: 352) | PREDICTED: *Homo sapiens* similar to prothymosin alpha, transcript variant 1 (LOC643287), mRNA. |
| −0.590984232 | LOC728755 | XM_001128377.2 (SEQ ID NO: 353) | PREDICTED: *Homo sapiens* similar to hCG1984907 (LOC728755), mRNA. |
| −0.597068853 | ALDH1A1 | NM_000689.3 (SEQ ID NO: 354) | *Homo sapiens* aldehyde dehydrogenase 1 family, member A1 (ALDH1A1), mRNA. |
| −0.639014352 | ALDH1A1 | NM_000689.3 (SEQ ID NO: 354) | *Homo sapiens* aldehyde dehydrogenase 1 family, member A1 (ALDH1A1), mRNA. |
| −0.804986707 | HLA-DRB6 | NR_001298.1 (SEQ ID NO: 355) | *Homo sapiens* major histocompatibility complex, class II, DR beta 6 (pseudogene) (HLA-DRB6), non-coding RNA. |
| −0.933938319 | FCER1A | NM_002001.2 (SEQ ID NO: 356) | *Homo sapiens* Fc fragment of IgE, high affinity I, receptor for; alpha polypeptide (FCER1A), mRNA. |

The predictive power of the signature is shown by its excellent sensitivity and specificity. As can be seen in a ROC analysis (FIGS. 1A and 1B), both these parameters are remarkably high.

It is clear that these data support our working hypothesis that PBM are indeed "imprinted" by the tumor, and that there is a subset of genes showing altered expression in monocytes in patients with cancer compared to healthy controls.

Example 2

Independent Validation of the Diagnostic Signature

To further optimize and validate the signature, a qRT-PCR analysis was undertaken to confirm the expression profile data. Instead of the full list of genes, the list was pruned to the combined genes of the two limma signatures. This was done because these signatures showed high overlap and each separately performed similar to the merged signature. Thus, it was reasoned that this more limited set of genes would perform similarly. qPCR was chosen because expression changes can be more easily picked up in this analysis. The list of genes selected for this analysis is shown in Table II.

TABLE II

Genes selected for further qRT-PCR analysis, with indication of regulation in cancer settings based on the microarray data.

| Gene abbreviation | Definition | Up- or down-regulated in cancer as compared to healthy control |
|---|---|---|
| ADM | *Homo sapiens* adrenomedullin (ADM), mRNA. | Up |
| CTSZ | *Homo sapiens* cathepsin Z (CTSZ), mRNA. | Up |
| HBA1 | *Homo sapiens* hemoglobin, alpha 1 (HBA1), mRNA. | Up |
| HBB | *Homo sapiens* hemoglobin, beta (HBB), mRNA. | Up |
| TAF15 | *Homo sapiens* TAF15 RNA polymerase II, TATA box binding protein (TBP)-associated factor, 68kDa (TAF15), mRNA. | Up |
| ACP5 | acid phosphatase 5, tartrate resistant | Up |
| ALDH1A1 | *Homo sapiens* aldehyde dehydrogenase 1 family, member Al (ALDH1A1), mRNA. | Up for primary tumors; down for metastasized tumors |
| APP | amyloid beta (A4) precursor protein | Up |
| ENSA | Endosulfine alpha | Up for primary tumors; no significant difference with healthy control for metastasized tumors |
| CCR1 | *Homo sapiens* chemokine (C-C motif) receptor 1 (CCR1), mRNA. | Up |
| CD68 | macrophage antigen CD68 (GP110, LAMP4, SCARD1, macrosialin) | Up |
| DDIT4 | *Homo sapiens* DNA-damage-inducible transcript 4 (DDIT4), mRNA. | Up |
| LOC100170833 | PREDICTED: Homo sapiens hypothetical protein LOC100170833, mRNA. | Up |
| FCER1A | *Homo sapiens* Fc fragment of IgE, high affinity I, receptor for; alpha polypeptide (FCER1A), mRNA. | Down |
| HLA-DRB4 | *Homo sapiens* major histocompatibility complex, class II, DR beta 4 (pseudogene). | Up |
| IER2 | *Homo sapiens* immediate early response 2 (IER2), mRNA. | Up |
| LAPTM4A | lysosomal protein transmembrane 4 alpha (MBNT, HUMORF13) | Up |
| SEPT5 | *Homo sapiens* septin 5 (SEPT5), mRNA. | Up |

TABLE II-continued

Genes selected for further qRT-PCR analysis, with indication of regulation in cancer settings based on the microarray data.

| Gene abbreviation | Definition | Up- or down-regulated in cancer as compared to healthy control |
|---|---|---|
| TKT | Homo sapiens transketolase (Wernicke-Korsakoff syndrome) (TKT), mRNA. | Up |
| ARPC1B | actin related protein 2/3 complex, subunit 1B, 41 kDa | Up |
| BAX | Homo sapiens BCL2-associated X protein (BAX), mRNA. | Up |
| DNAJC7 | Homo sapiens DnaJ (Hsp40) homolog, subfamily C, member 7 (DNAJC7), mRNA. | Up |
| FKBP5 | Homo sapiens FK506 binding protein 5 (FKBP5), mRNA. | Up |
| GPER | Homo sapiens G protein-coupled estrogen receptor 1 (GPER), mRNA. | Up |
| HMOX1 | Homo sapiens heme oxygenase (decycling) 1 (HMOX1), mRNA. | Up |
| HP | Homo sapiens haptoglobin (HP), mRNA. | Up |
| IL1R2 | interleukin 1 receptor, type II | Up |
| S100P | Homo sapiens S100 calcium binding protein P (S100P), mRNA. | Up |
| SLC39A1 | Homo sapiens solute carrier family 39 (zinc transporter), member 1 (SLC39A1), mRNA. | Up |
| SOCS3 | Homo sapiens suppressor of cytokine signaling 3 (SOCS3), mRNA. | Up |
| HNRNPK | Homo sapiens heterogeneous nuclear ribonucleoprotein K (HNRNPK), mRNA. | Up |
| RILPL2 | Rab interacting lysosomal protein-like 2 | Up |
| TNPO1 | Homo sapiens transportin 1 (TNPO1), mRNA. | Up |
| HLA-DQA1 | major histocompatibility complex, class II, DQ alpha 1 | Up |
| LOC100170939 | Homo sapiens glucuronidase, beta pseudogene (LOC100170939), non-coding RNA. | Up |
| LOC644063 | PREDICTED: Homo sapiens hypothetical protein LOC644063 (LOC644063), mRNA. | Up |
| LOC723972 | Homo sapiens hepatopoietin PCn127 (LOC723972), non-coding RNA. | Up |
| RN28S1 | RNA, 28S ribosomal 1 | Up |
| SDHC | succinate dehydrogenase complex, subunit C, integral membrane protein, 15 kDa | Up |
| CCL18 | chemokine (C-C motif) ligand 18 (pulmonary and activation-regulated) | Up |
| TNF | tumor necrosis factor | Up for primary tumors; down for metastasized tumors |
| CXCL9 | chemokine (C-X-C motif) ligand 9 | Down |
| SLPI | secretory leukocyte peptidase inhibitor | Up |
| CXCR4 | chemokine (C-X-C motif) receptor 4 | Up |

Figure 2A:
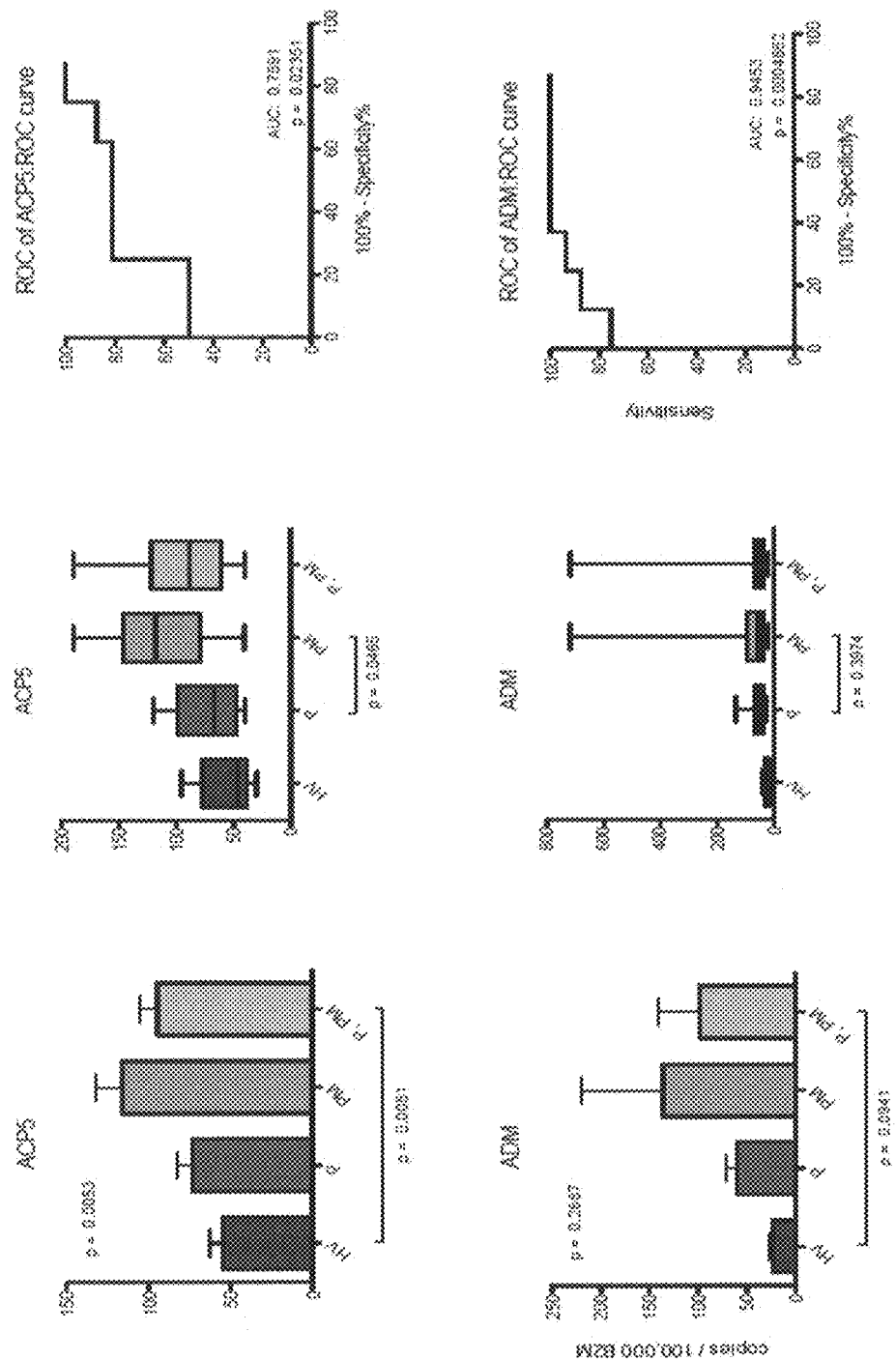
FIGS. 2A - 2O. mRNA expression levels for selected genes in a random subset of samples (n=8). Left panels show mean expression values and standard error of the mean, middle panels show Box-and-Whiskers Plot of the same data sets (dark line in middle is median value, top and bottom edges of the rectangles respectively represent the 75th and 25th percentile values, top and bottom lines are maximum and minimum values), right panels show the ROC curve (plot of the sensitivity, or true positive rate, vs. false positive rate (1–specificity or 1–true negative rate)). Normalization occurred against beta-2-microglobulin (B2M) levels (shown for most molecules) or actin expression levels (shown for DNAJC7, FCER1A, HLA-DQA1, LOC723972, and RN28S1), expression values are shown as copies/10,000 copies of B2M or actin. HV, healthy volunteers. P, patients with a primary tumor without evidence of metastatic disease. PM, patients with a metastasized tumor. P, PM: P and PM groups combined. p values in the left panel are calculated by 2-way ANOVA for differences between HV, P, and PM (top left corner) and by Student's two-sided t-test with Welch's correction for differences between HV and P, PM (below the bars). p values in the middle panel are calculated by Student's two-sided t-test with Welch's correction for differences between P and PM. p values in right panel are indicated for AUC.
Figure 2B:
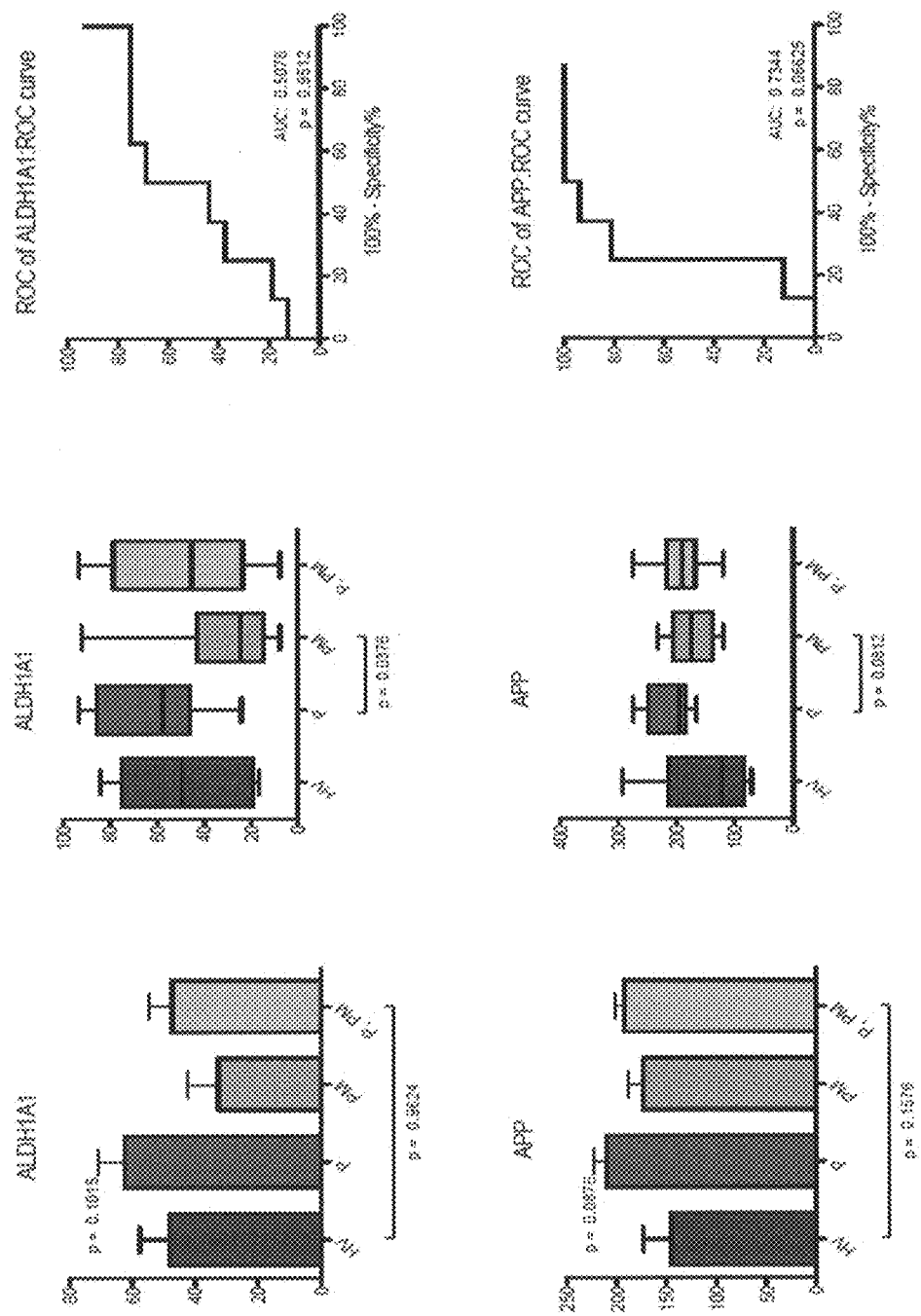
Figure 2C:
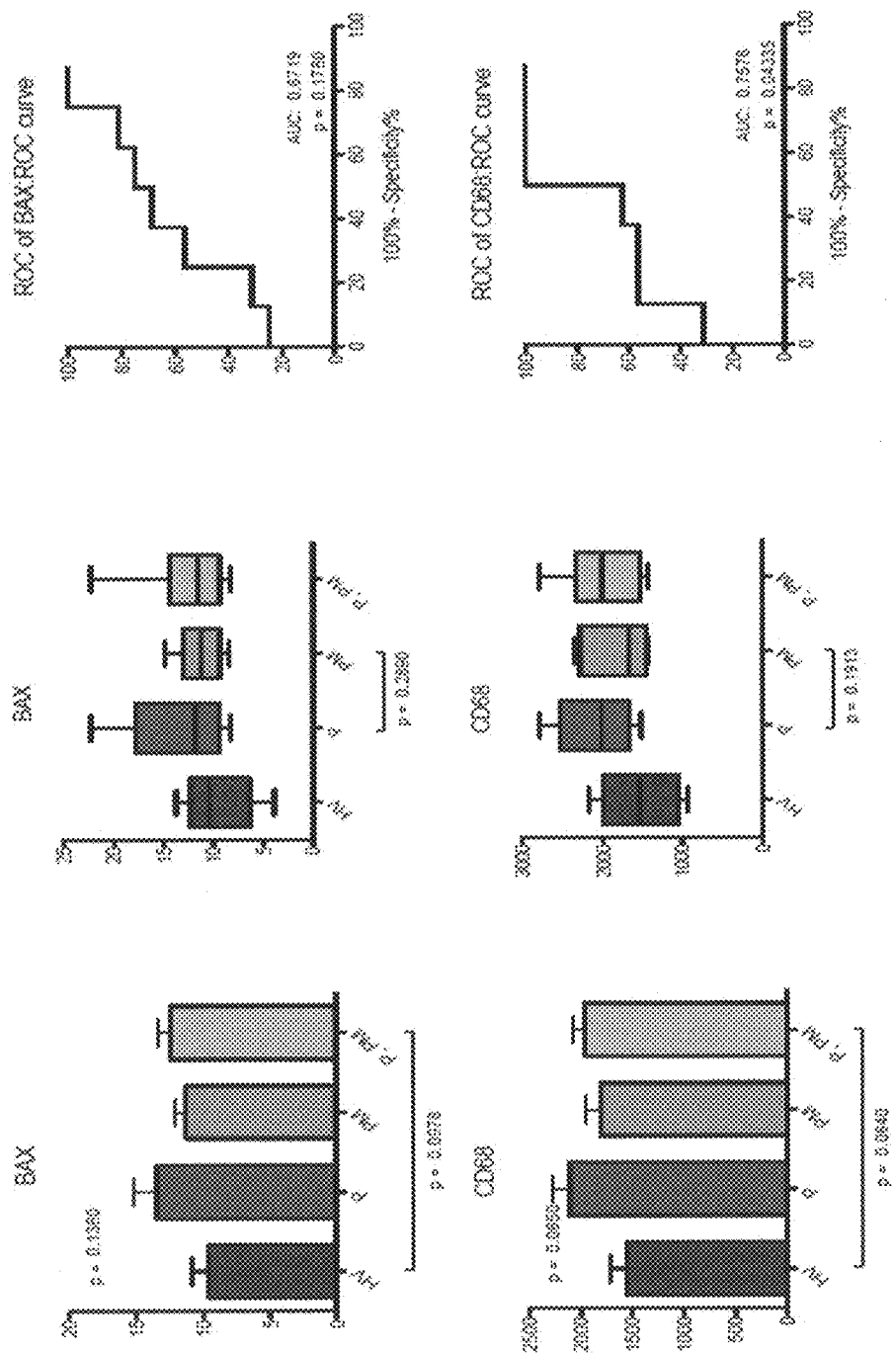
Figure 2D:
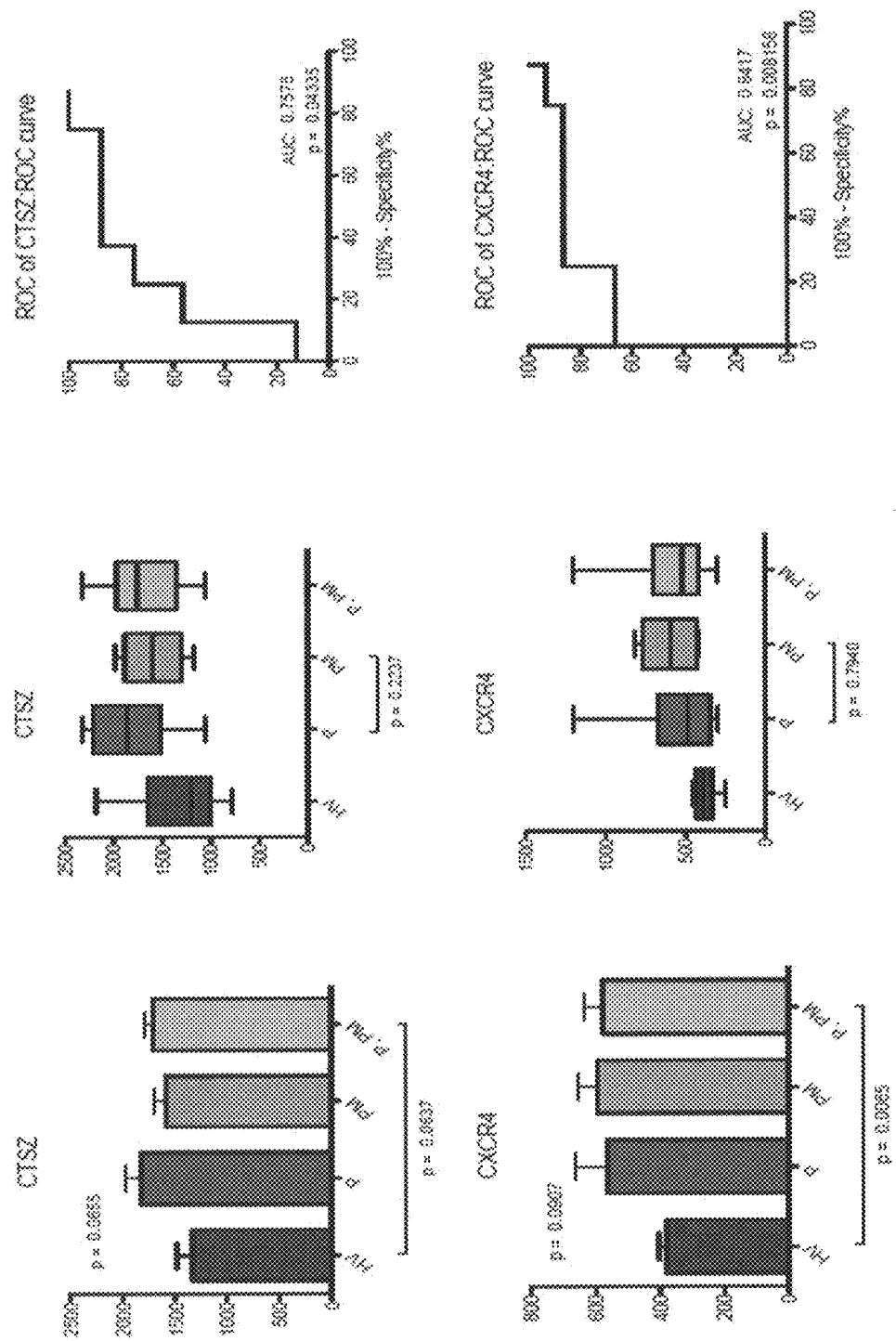
Figure 2E:
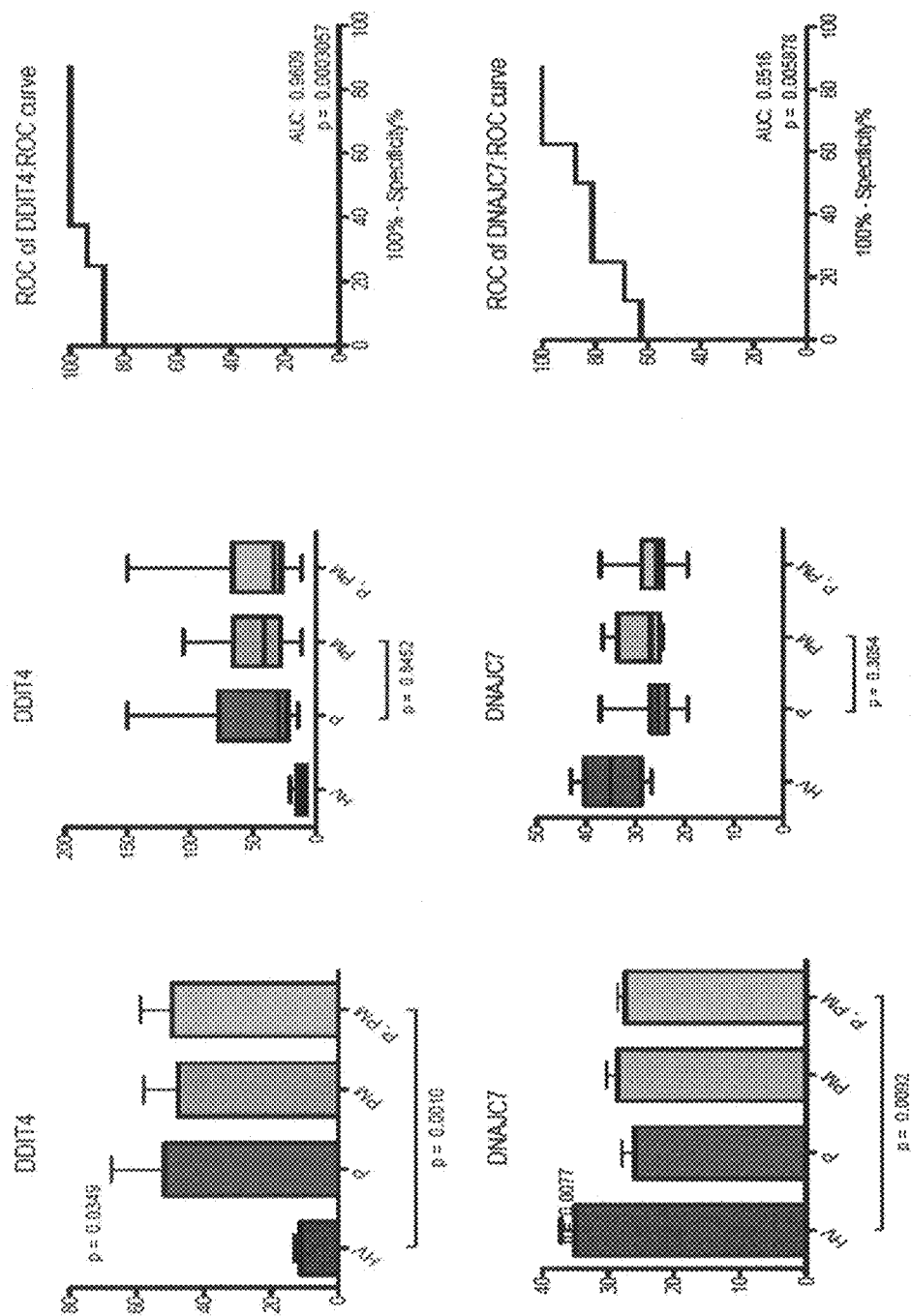
Figure 2F:
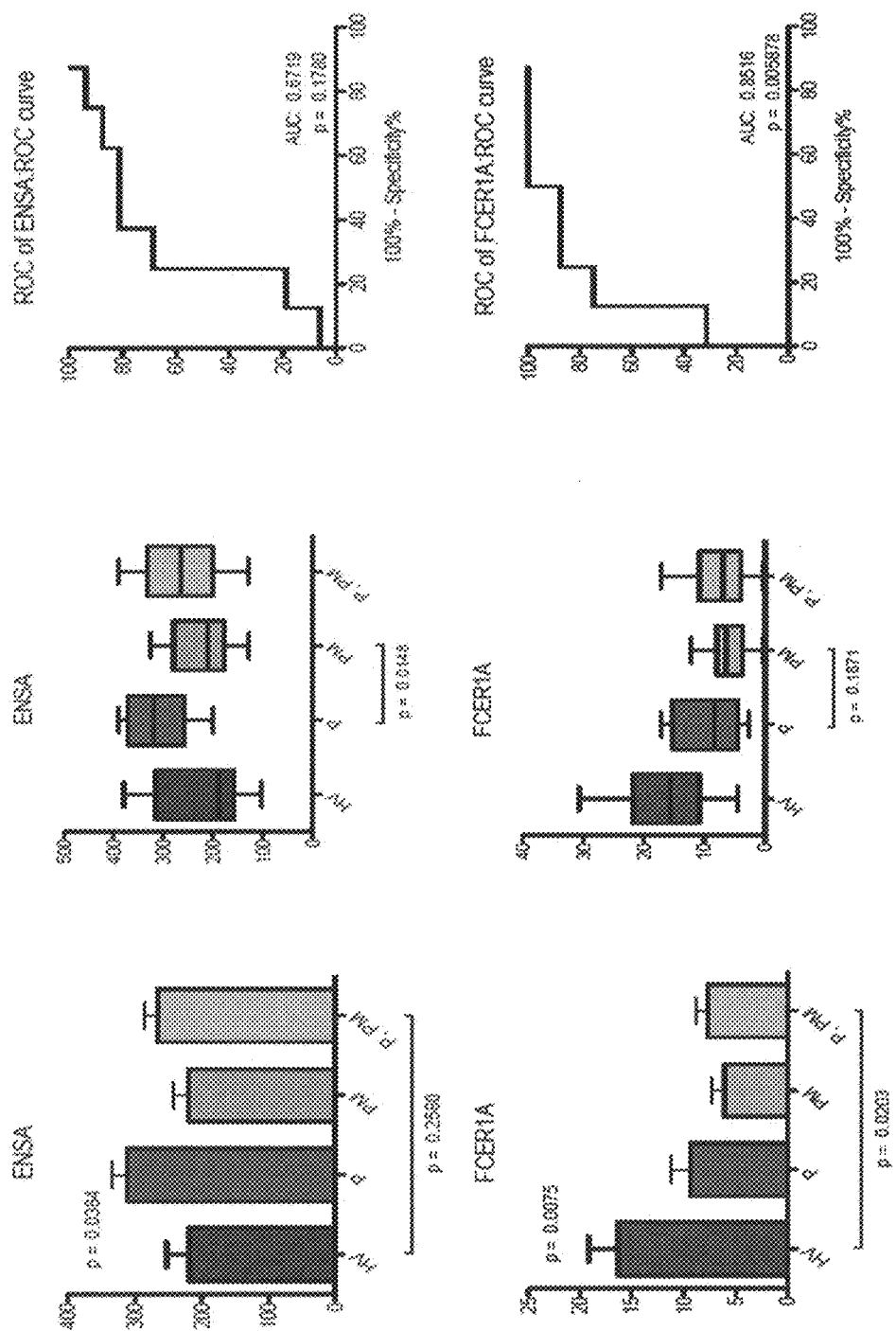
Figure 2G:
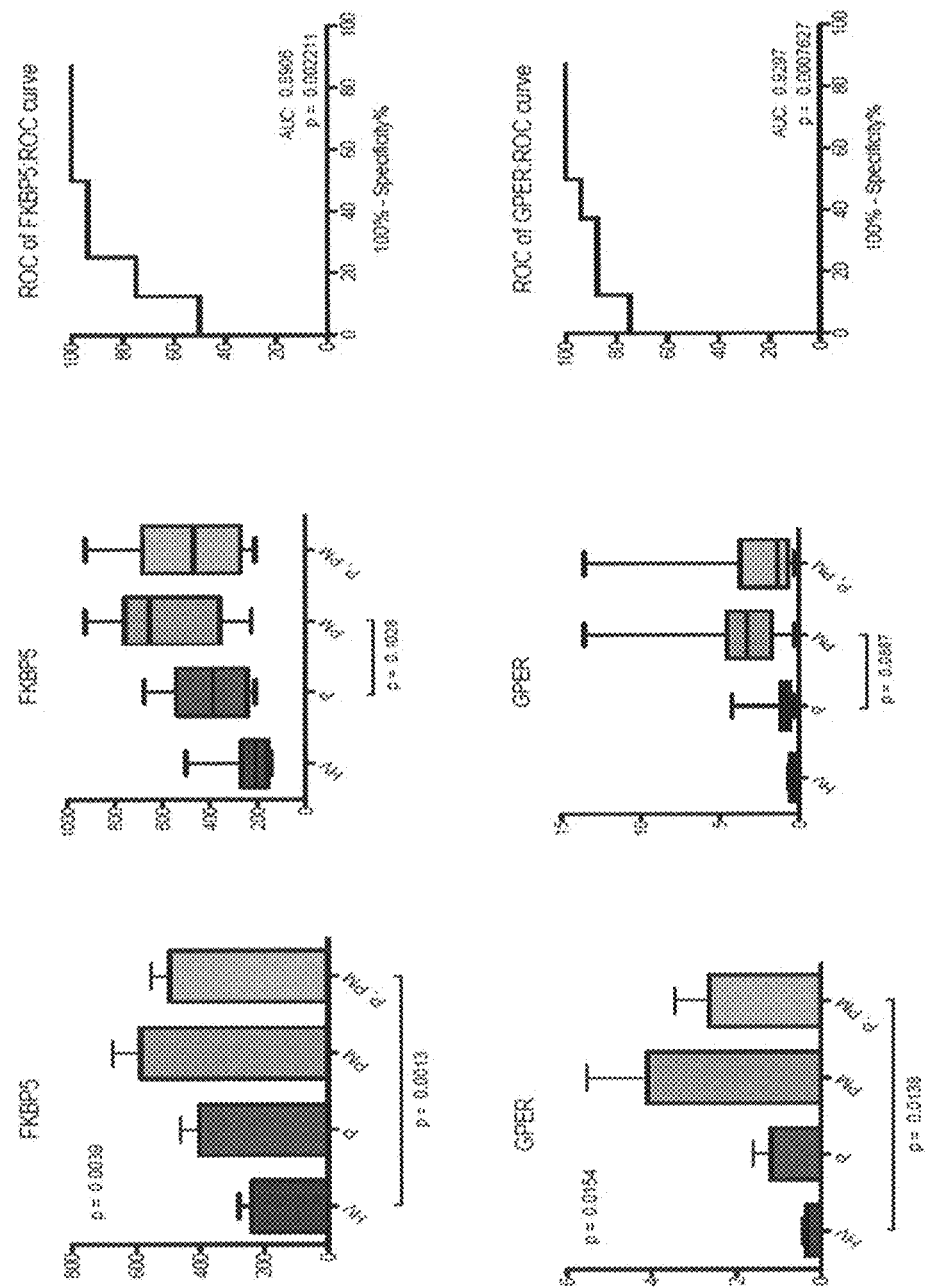
Figure 2H:
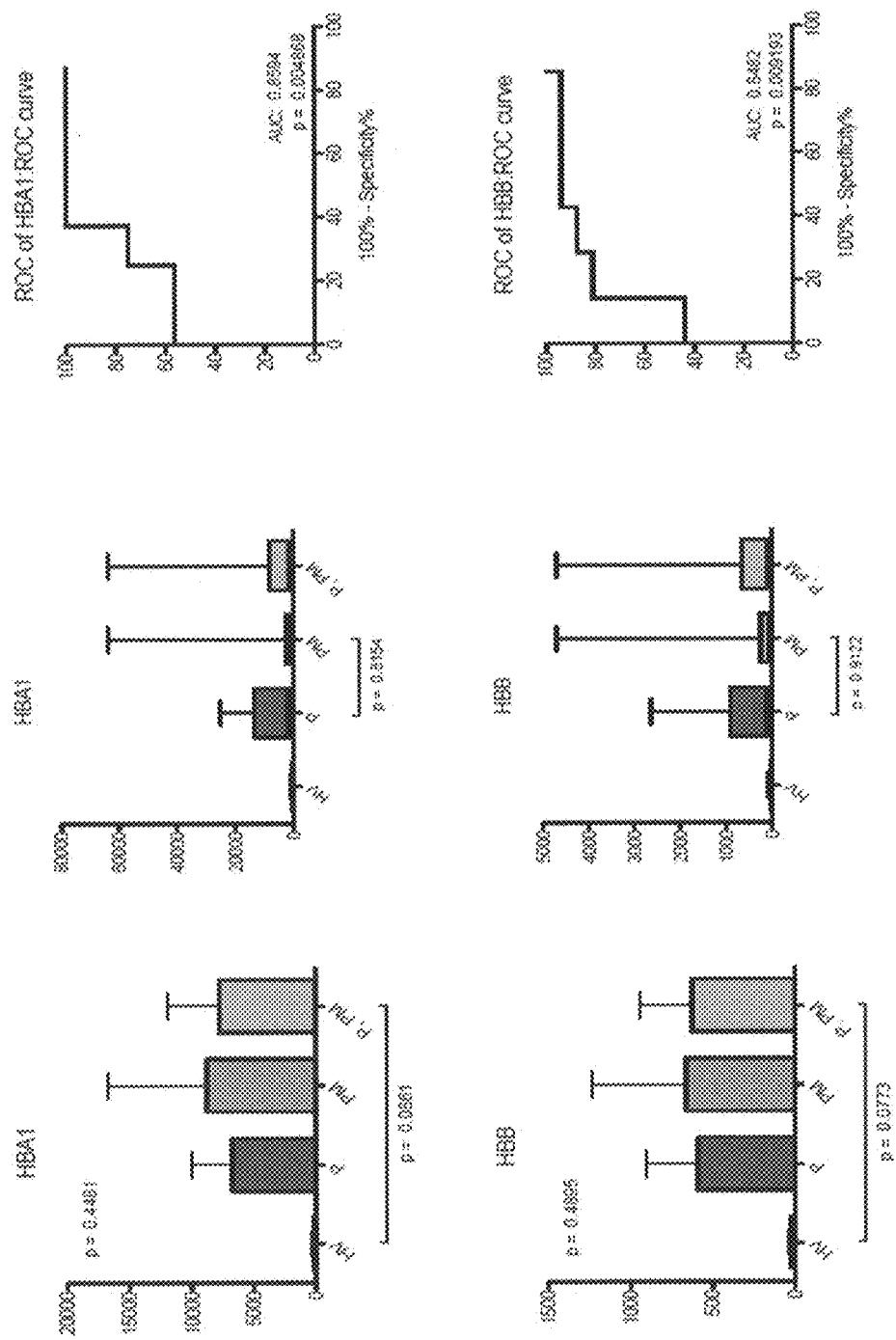
Figure 21:
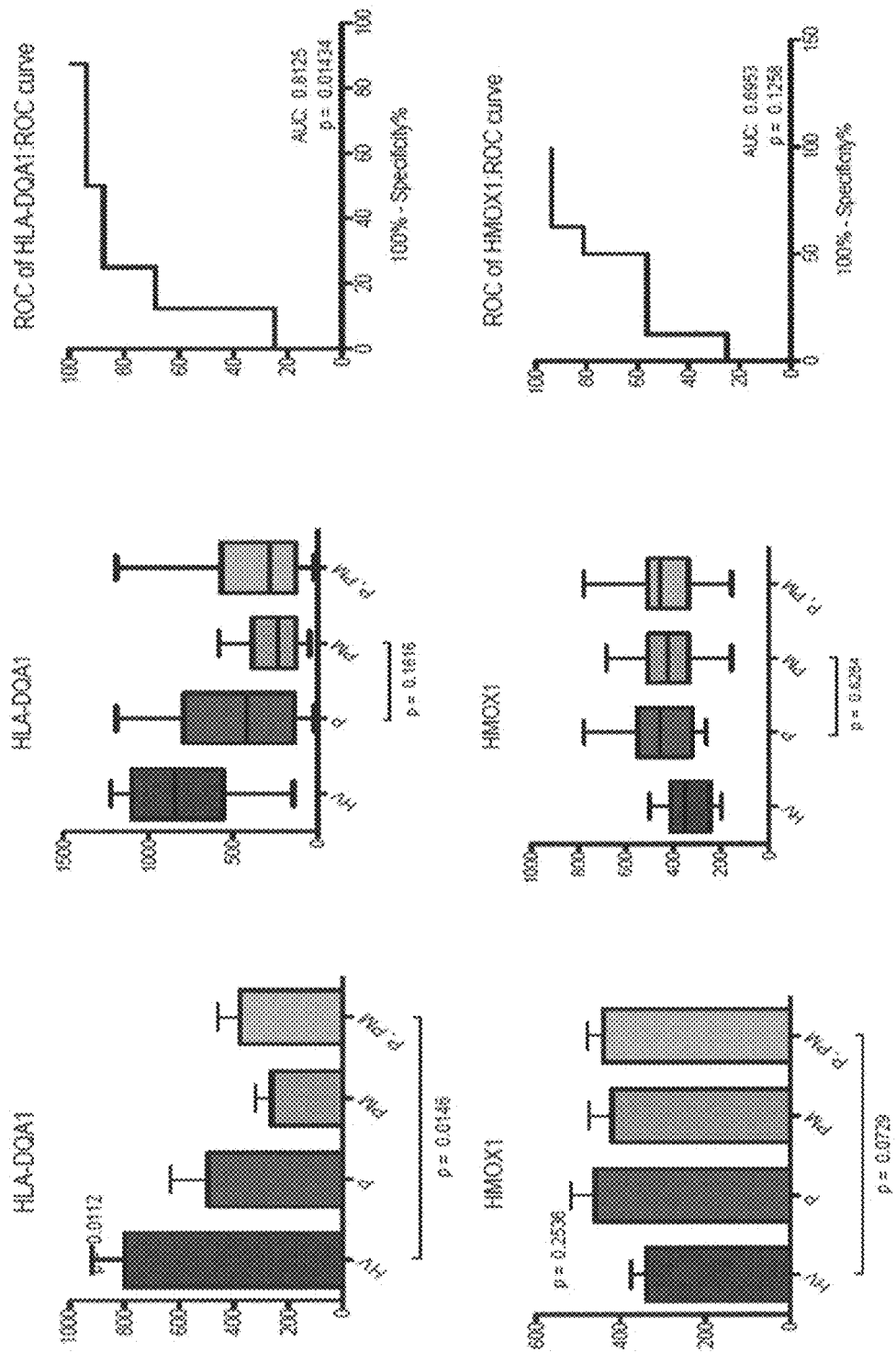
Figure 2J:
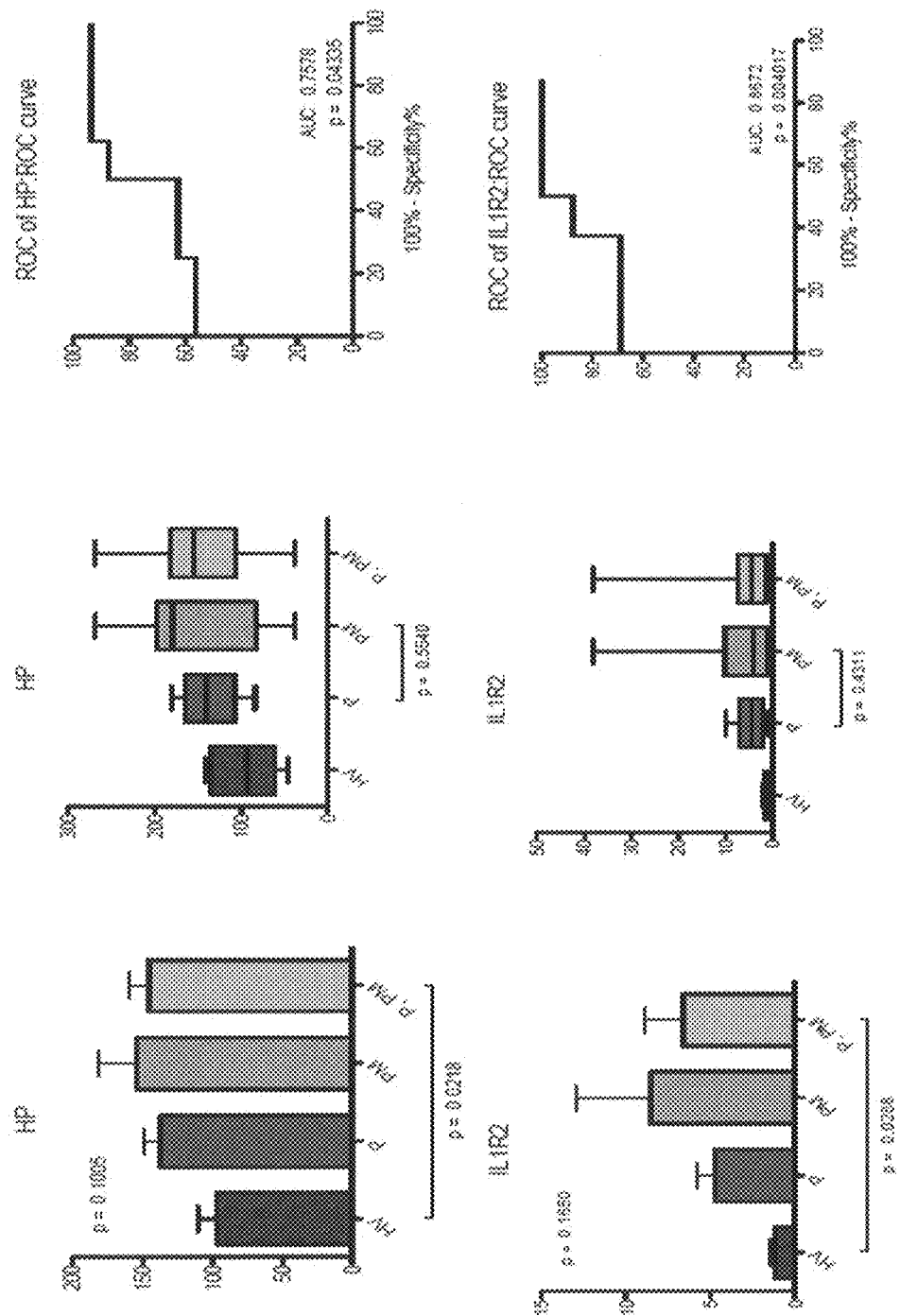
Figure 2K:
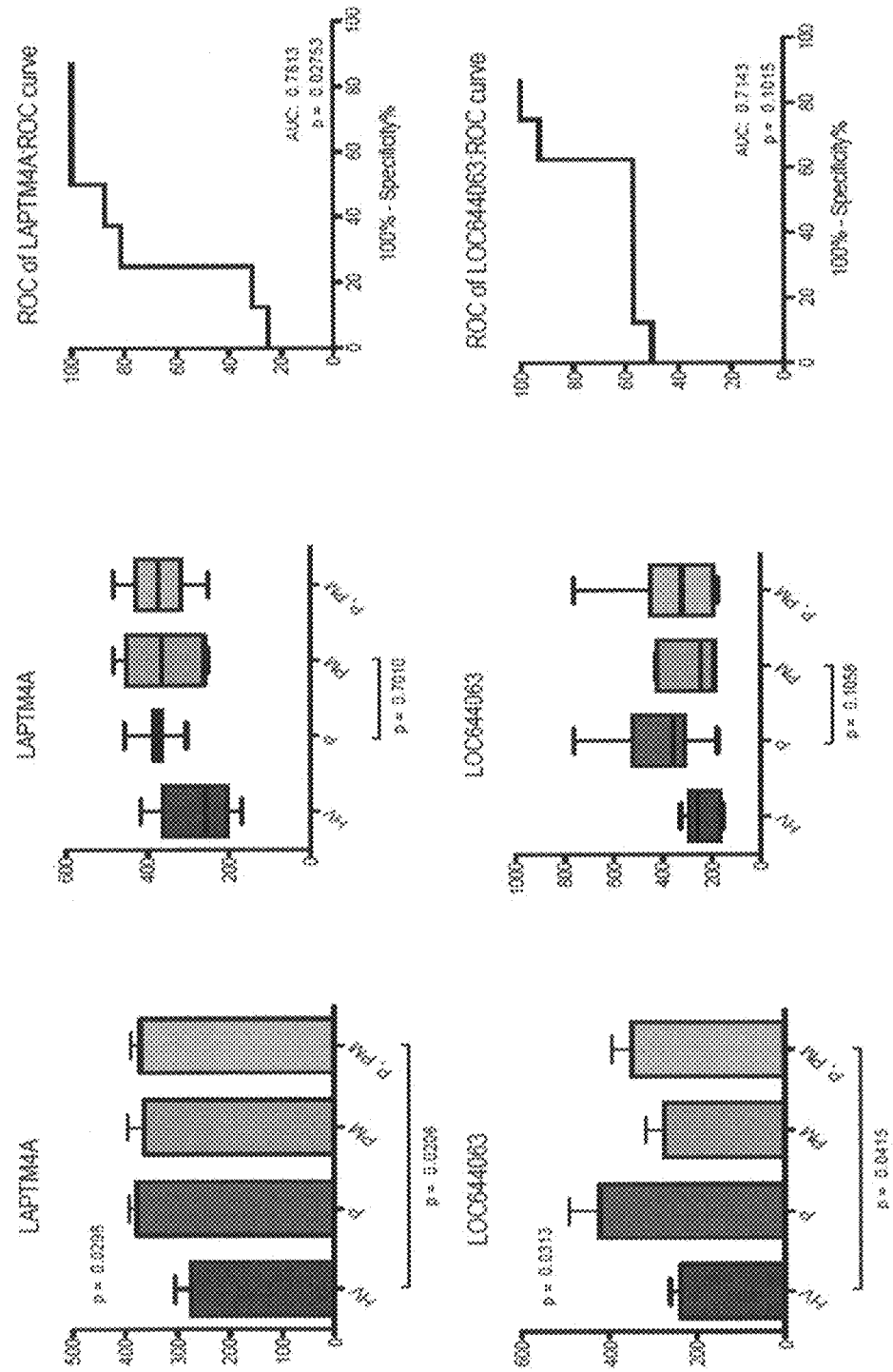
Figure 2L:
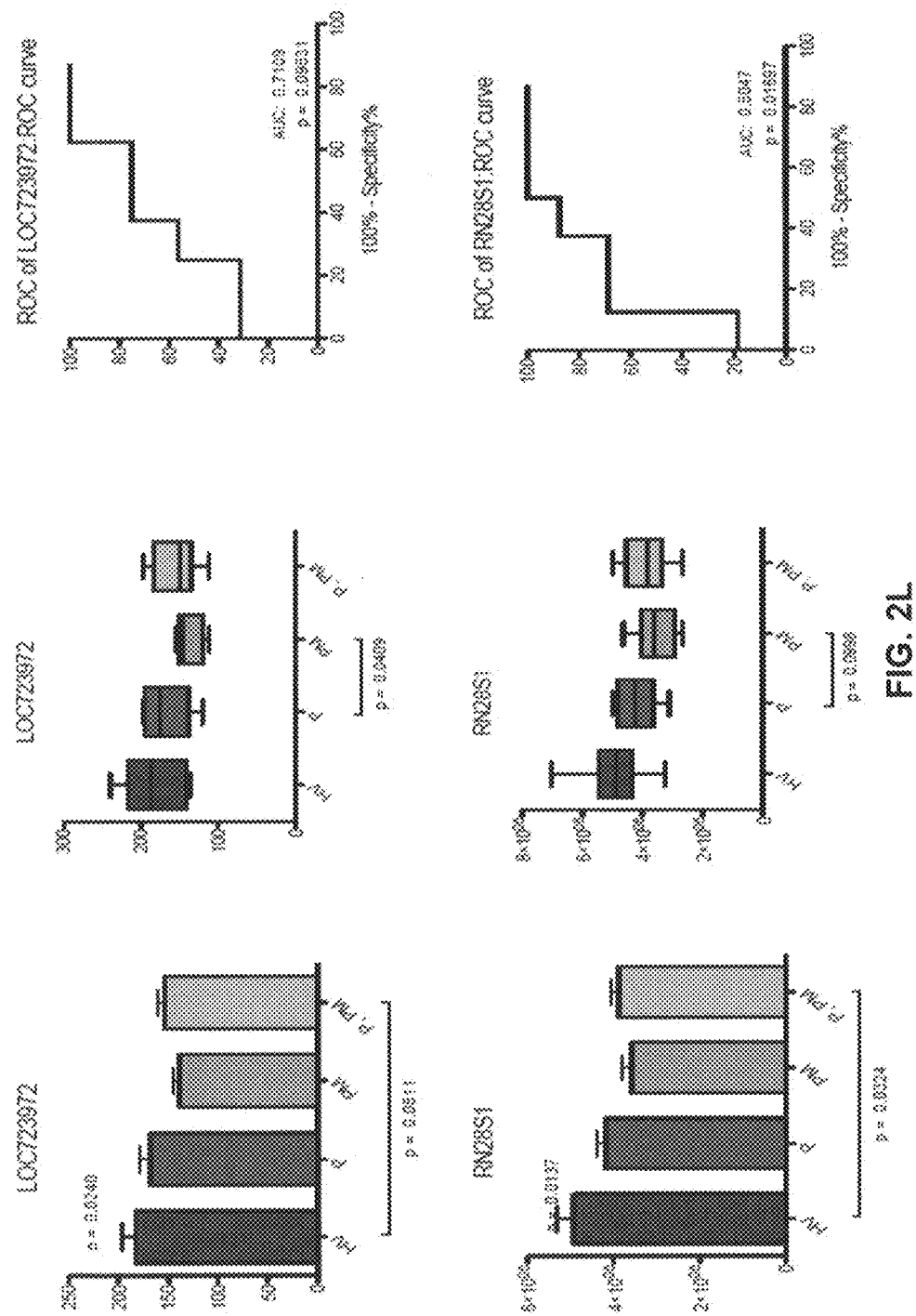
Figure 2M:
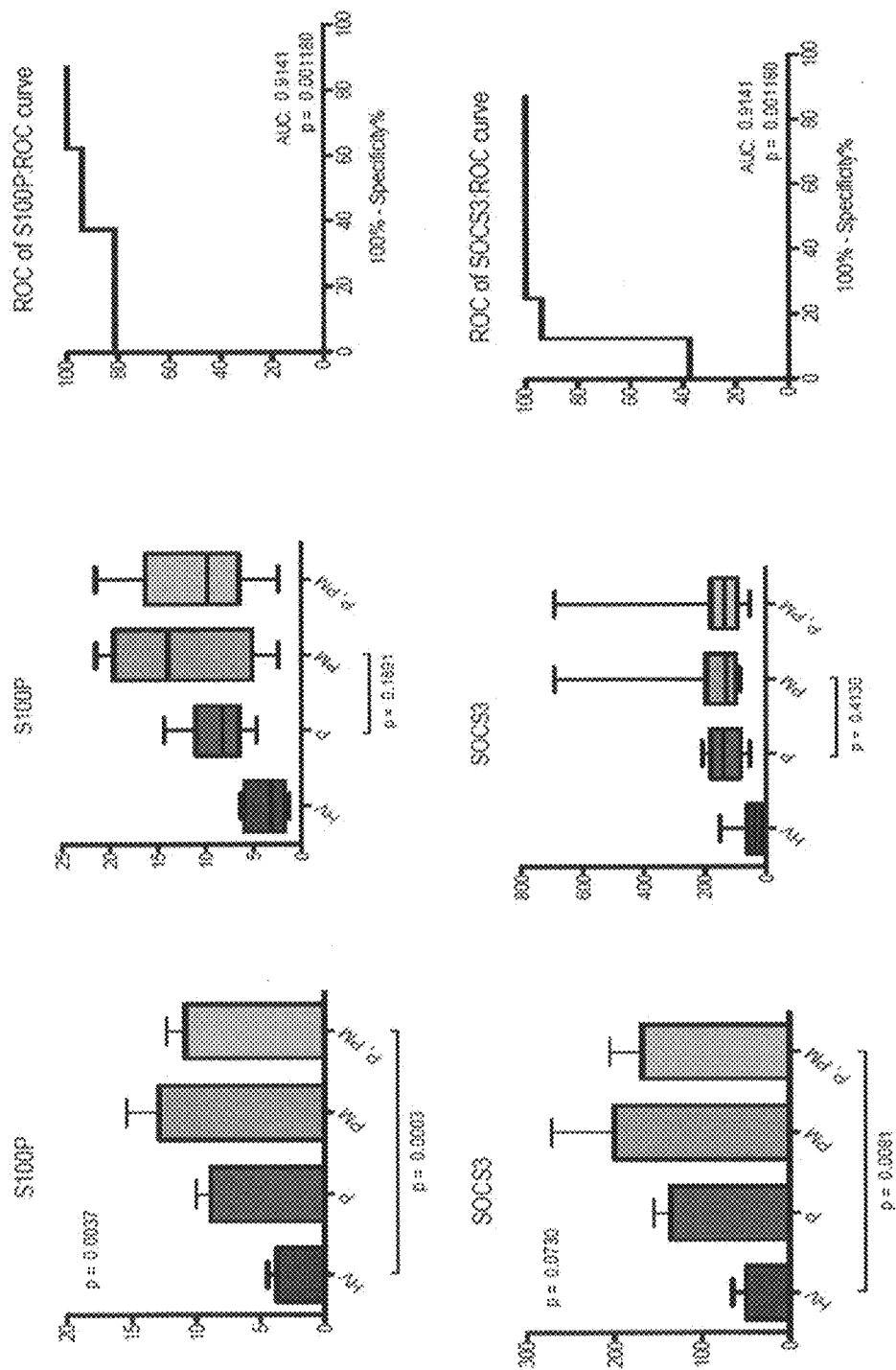
Figure 2N:
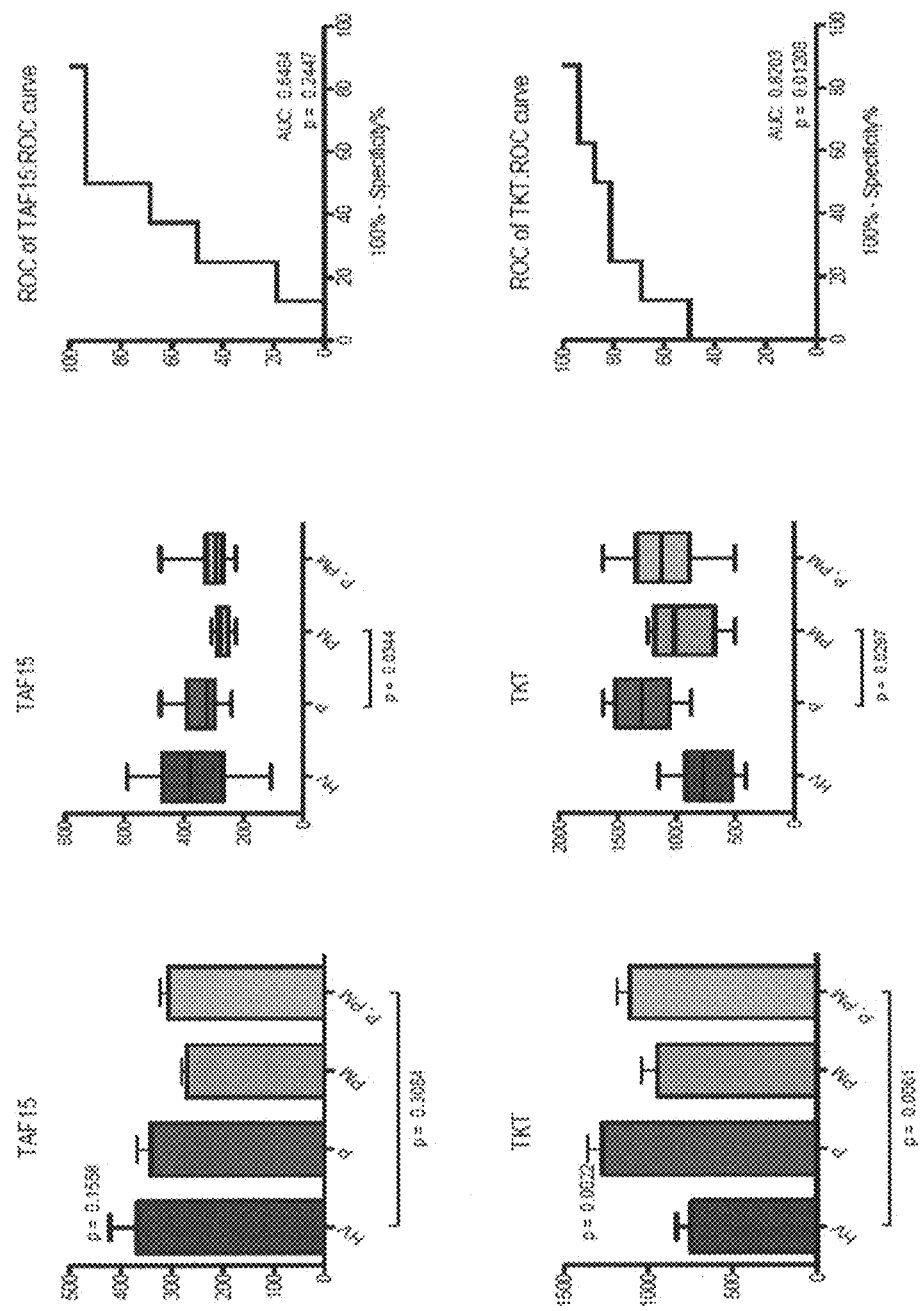
Figure 2O:
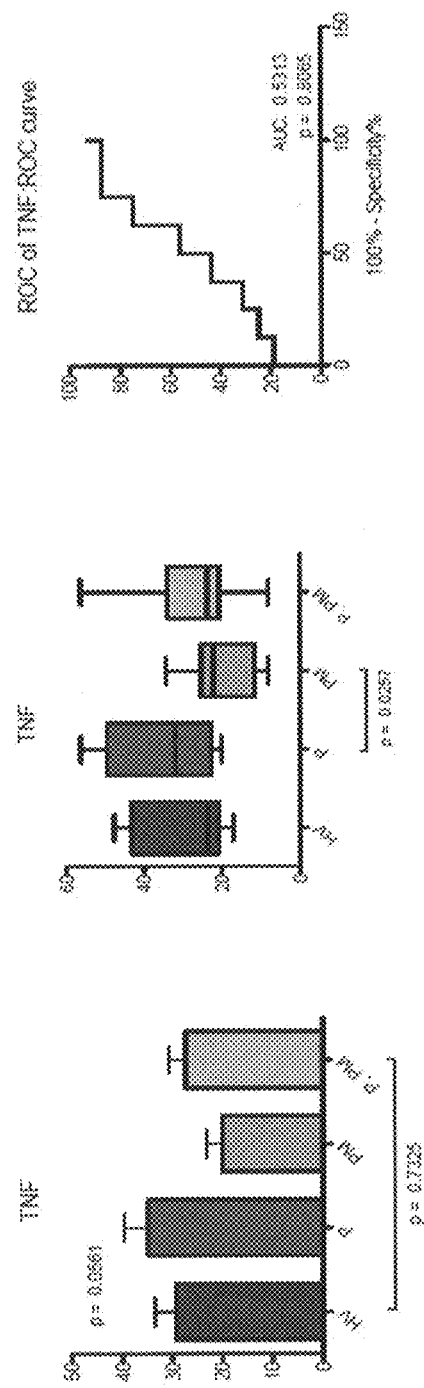

For this analysis, a second aliquot of the material used for the Illumina analysis was taken for random eight persons out of every group (HV, P, PM). From the stored lysed monocytes in buffer RLT, the RNA was freshly extracted.

mRNA expression levels for selected genes in Table II are shown in FIGS. 2A - 2O. It can be seen that the qRT-PCR analysis confirms the findings by Illumina, and these genes show indeed altered expression in the groups with non-metastatic or metastatic cancer as compared to the healthy control group. As can be expected, the effect is not as pronounced for every gene. In this regard, it has to be taken into account that the sample size for the RT-PCR (n=8) is considerably smaller than that for the Illumina analysis.

Also, there is a slight (quantitative) difference when samples are normalized for beta-2-microglobulin levels or for actin levels, although this does not affect the (qualitative) direction of the effect. For four markers, the altered expression in disease setting differs between the Illumina and qPCR analysis. This can be due to a number of factors: sensitivities of the methodology, specificity of the Illumina probes in comparison to the qPCR assays, the fact that Illumina analysis combines P and PM groups, a different normalization used, etc. The qPCR data are believed to be correct (since qPCR is a technique better suited to detect changes in expression), and these markers are in principle reliable. However, according to particular embodiments, these four genes (i.e., DNAJC7, LOC723972, RN28S1, and TAF15) are not used as a monocyte expression marker.

It is striking that a number of genes show such significantly altered expression that their expression alone retains high predictive power, as can, e.g., be seen from the area under curve graph. This is for instance true for DDIT4 (AUC: 0.9609), ADM (AUC: 0.9453), GPER (AUC: 0.9297), S100P (AUC: 0.9141) and SOCS3 (AUC: 0.9141). So expression of one of these genes alone can even be used as marker. Of note, although these are the best performing ones as sole markers, they are not exceptional. Also FKBP5, IL1R2, FCER1A and HBA1 for instance show AUC values of over 0.85; and it is likely that further analysis of markers may reveal that more of the 336 genes can be used as single markers.

Interestingly, the qRT-PCR analysis also shows that some particular markers also make the distinction between the P and PM patient groups, possibly due to over-amplification of expression differences that were non-significant in the microarray data. This is, e.g., the case for the ACP5, ADM, ALDH1A1, APP, CD68, ENSA, FKBP5, GPER, HLA-DQA1, LOC644063, LOC723972, RN28S1, S100P, TAF15, TKT and TNF markers. Most particularly envisaged are markers selected from the list of: ACP5, ALDH1A1, ENSA, LOC644063, LOC723972, TAF15, TKT and TNF; as these markers have a very low p value when comparing expression values in monocytes from patients with non-metastasized versus metastasized tumors.

In case of ACP5, ADM, FKBP5, GPER, HLA-DQA1, LOC723972, RN28S1, S100P, and TAF 15 the difference between the HV and P groups is further increased between the HV and PM groups—the expression level thus is a direct indication of whether the patient is in the P or PM group. Note that the increase in difference applies both for markers that are up-regulated as for markers whose expression is down-regulated (e.g., HLA-DQA1, LOC723972, TAF15)—in this case, an increased difference means a further down-regulation.

In case of other markers like CD68, TKT and LOC644063 the difference (e.g., increase) between P and HV is larger than that between the PM and HV groups (e.g., in case of increased levels in P vs. HV, levels in PM are decreased compared to P—see also Table III). There may not always be a significant difference anymore between the PM and HV groups, but there remains a significant difference between the levels in the combined P, PM groups and the HV group. In some cases, like APP and ENSA, there is a significant difference between HV and P groups, but the trend reversal is so strong that there is no significant difference any more between HV and PM or the combined P, PM groups (using a significance cut-off value of p=0.1). Whereas these markers alone would not be prime candidates to discriminate between PM and HV, they can be used in combination with other markers that can establish the presence of cancer (i.e., indicate that the patient is either P or PM). The levels of these markers can then discriminate between the P and PM groups. In other words, when the presence of cancer is established, these markers can be used to classify the cancer as metastatic or non-metastatic. They are also useful as sole marker to detect non-metastasized cancer (but not as sole marker to detect metastasized cancer).

In case of ALDH1A1 and TNF, the difference between the HV and P groups is quite small, but there is a very significant difference between the P and PM group. This marker can thus be used together with other markers that can discriminate between P, PM and HV but not necessarily between P and PM groups to check whether a patient has a primary or metastasized tumor.

An overview of the markers shown in FIGS. 2A - 2O is incorporated in Table III, including parameters that show their value as disease and progression marker.

TABLE III

Some relevant parameters for the genes shown in FIGS. 2A-2O. Up, down, same: indicates whether expression levels for the gene product marker are up-regulated, down-regulated or not significantly changed, respectively, between the groups listed in the column header.

| gene | p HV-total cancer (P, PM groups) | p P-PM | AUC for ROC curve | P vs. HV | PM vs. HV | PM vs. P |
|---|---|---|---|---|---|---|
| ACP5 | 0.0081 | 0.0465 | 0.7891 | Up | up | up |
| ADM | 0.0941 | 0.3974 | 0.9453 | up | up | up |
| ALDH1A1 | 0.9624 | 0.0376 | 0.5078 | up | down | down |
| APP | 0.1576 | 0.0812 | 0.7344 | up | up | down |
| BAX | 0.0978 | 0.289 | 0.6719 | up | up | down |
| CD68 | 0.064 | 0.1913 | 0.7578 | up | up | down |
| CTSZ | 0.0637 | 0.2237 | 0.7578 | up | up | down |
| CXCR4 | 0.0065 | 0.794 | 0.8417 | up | up | same |
| DDIT4 | 0.001 | 0.8452 | 0.9609 | up | up | same |
| DNAJC7 | 0.5431 | 0.7796 | 0.6172 | down | down | same |
| ENSA | 0.258 | 0.0148 | 0.6719 | up | same | down |
| FCER1A | 0.0768 | 0.2687 | 0.7266 | down | down | down |
| FKBP5 | 0.0013 | 0.1028 | 0.8906 | up | up | up |
| GPER | 0.0138 | 0.0887 | 0.9297 | up | up | up |
| HBA1 | 0.0861 | 0.8154 | 0.8594 | up | up | same |
| HBB | 0.0773 | 0.9122 | 0.8482 | up | up | same |
| HLA-DQA1 | 0.0918 | 0.1113 | 0.7656 | down | down | down |
| HMOX1 | 0.0729 | 0.6284 | 0.6953 | up | up | same |
| HP | 0.0218 | 0.554 | 0.7578 | up | up | same |
| IL1R2 | 0.0288 | 0.4311 | 0.8672 | up | up | same |
| LAPTM4A | 0.0206 | 0.701 | 0.7813 | up | up | same |
| LOC644063 | 0.0415 | 0.1058 | 0.7143 | up | up | down |
| LOC723972 | 0.9645 | 0.1874 | 0.5625 | down | down | down |
| RN28S1 | 0.5908 | 0.3764 | 0.5781 | down | down | down |
| S100P | 0.0003 | 0.1891 | 0.9141 | up | up | up |
| SOCS3 | 0.0081 | 0.413 | 0.9141 | up | up | up |
| TAF15 | 0.3084 | 0.0344 | 0.6484 | down | down | down |
| TKT | 0.0061 | 0.0297 | 0.8203 | up | up | down |
| TNF | 0.7325 | 0.0257 | 0.5313 | same/up | down | down |

All markers of Table III are also shown in FIGS. 2A - 2O.

Markers with a p value below 0.1 (or even more particularly below 0.05) in the first column are very reliable disease markers, as this is an indication how different values from the combined P and PM groups are from the values obtained from the HV control group.

Markers with a p value below 0.1 (or even more particularly below 0.05) in the second column are particularly suited as markers to discriminate between non-metastasized and metastasized tumors.

Markers with an AUC higher than 0.8 (or even more particularly higher than 0.85) are markers that are particularly suited as single markers: these markers combine a high sensitivity with a high specificity.

The three columns to the right indicate whether the marker is up- or down-regulated, or not significantly changed ("same") when comparing the two mentioned groups. This can be used to correlate the expression levels with presence of disease, or with the presence of metastasis (disease stage).

Example 3

Figure 3:
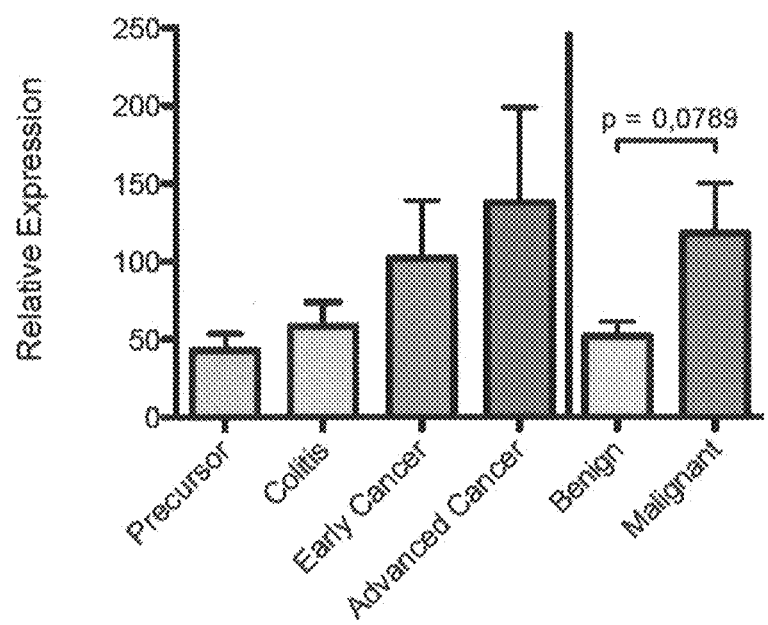
FIG. 3. Relative expression of DDIT4 in mice with (early and advanced cancer) and without (precursor, colitis) chemically induced neoplasms.
Figure 4A:
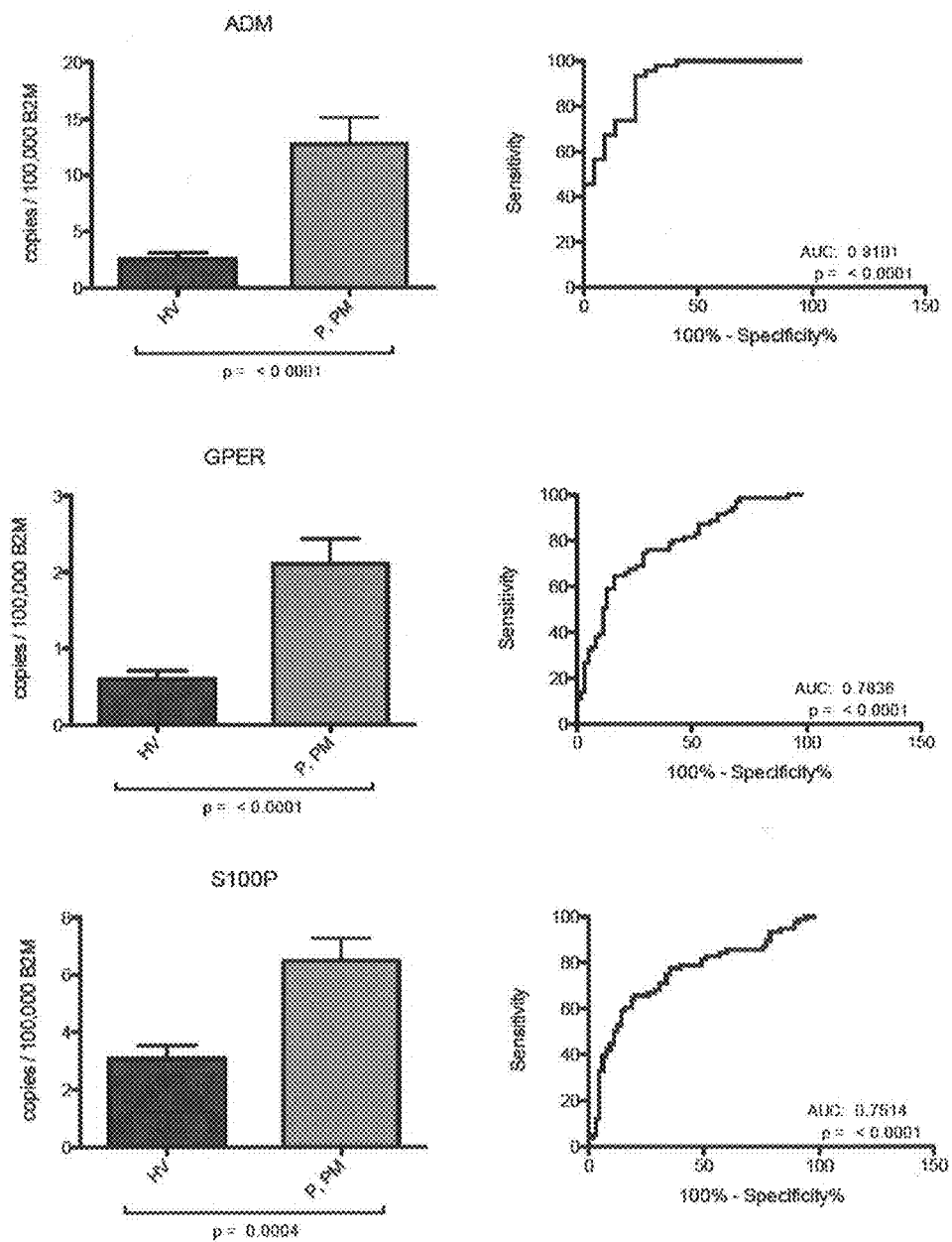
FIGS. 4A - 4G. mRNA expression levels for selected genes from a multicenter clinical study.
Figure 4B:
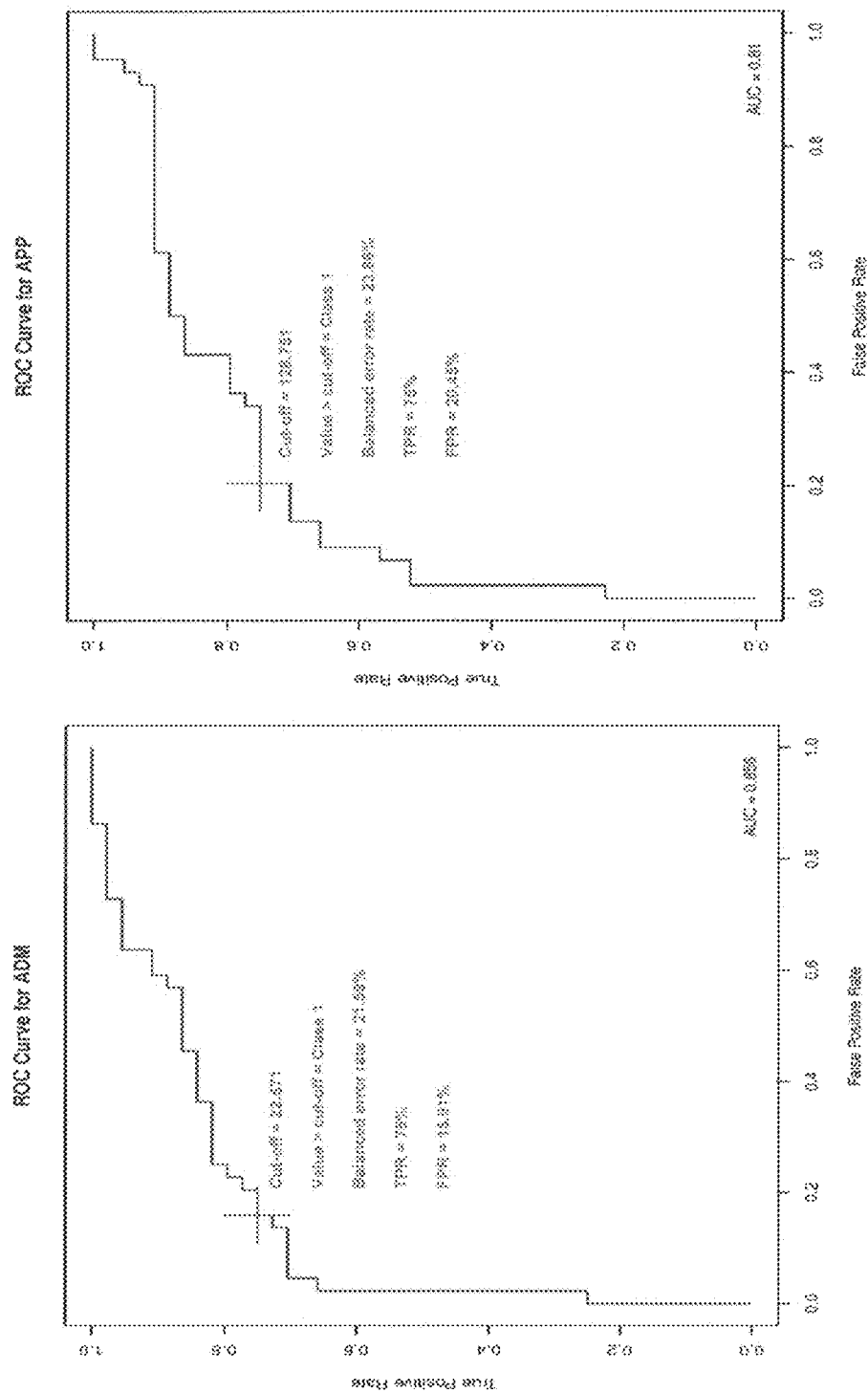
Figure 4C:
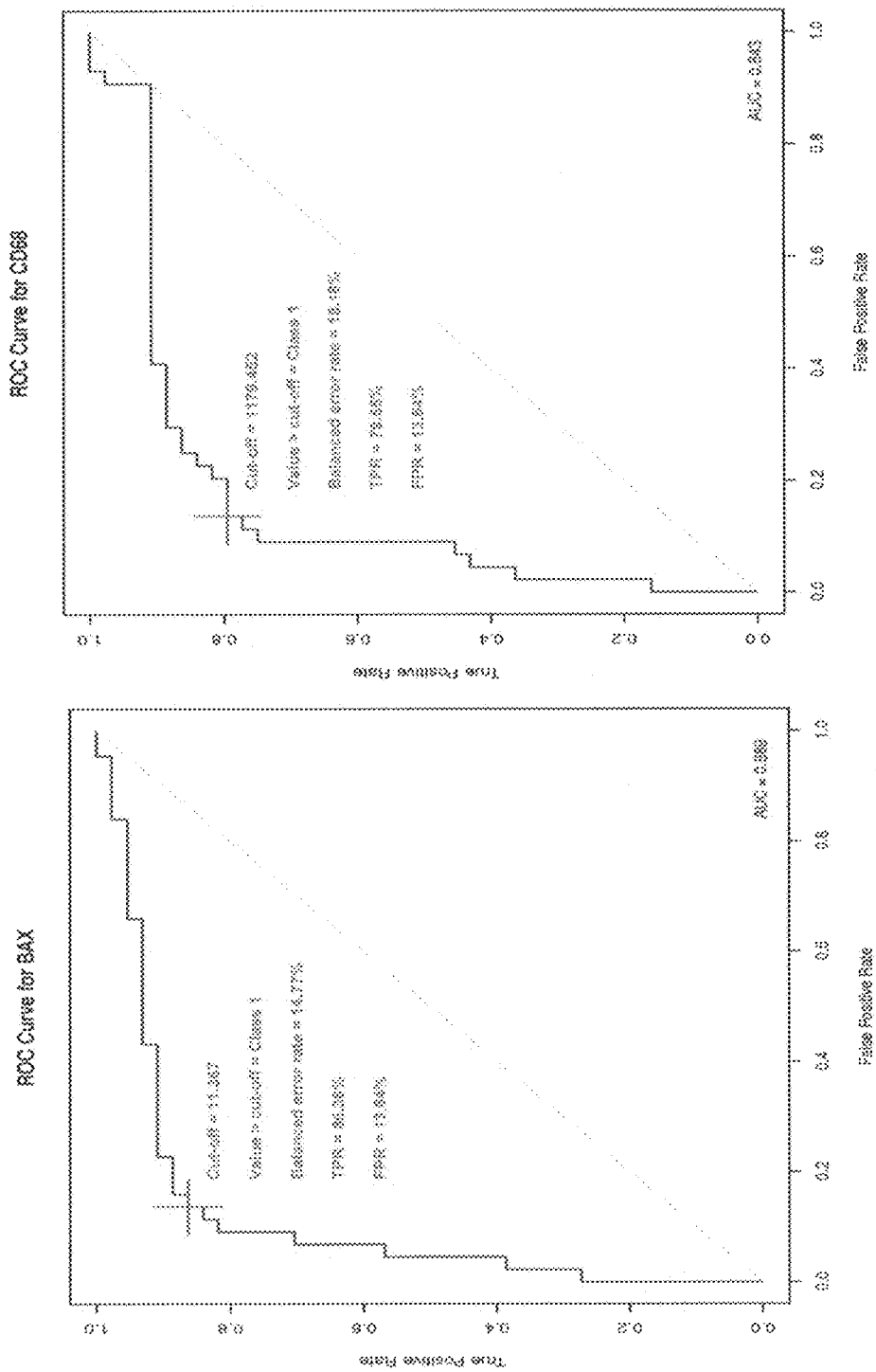
Figure 4D:
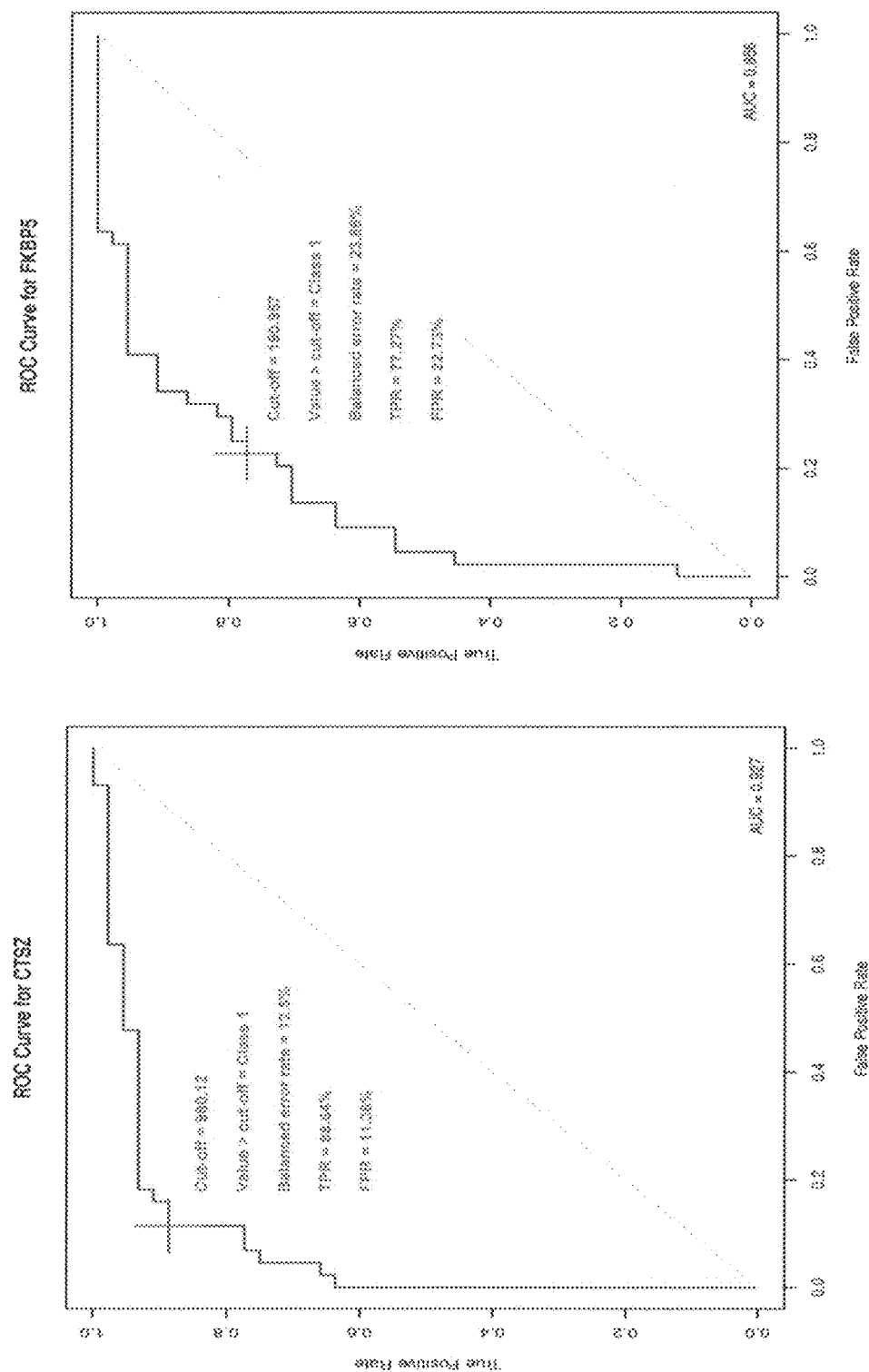
Figure 4E:
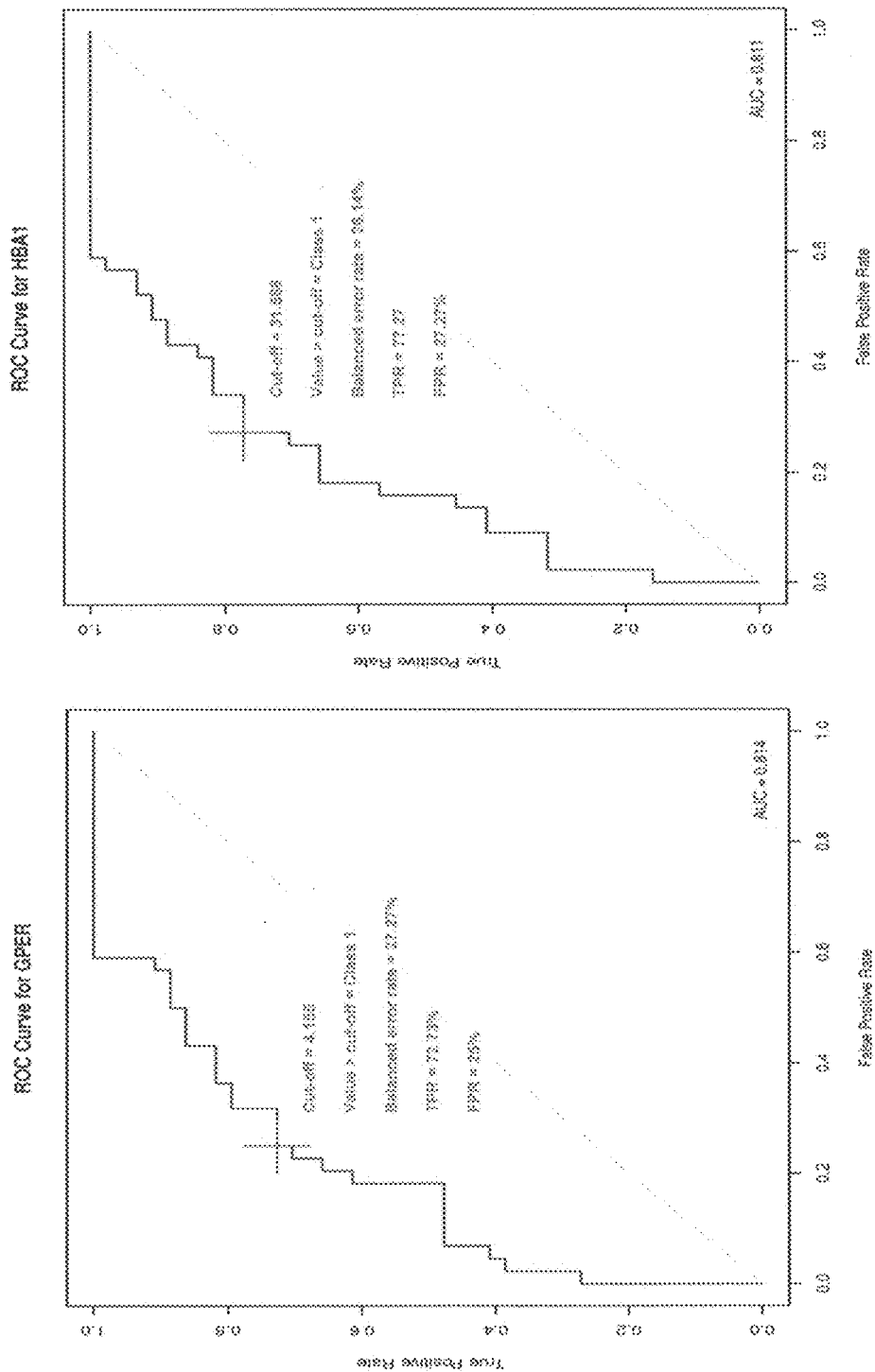
Figure 4F:
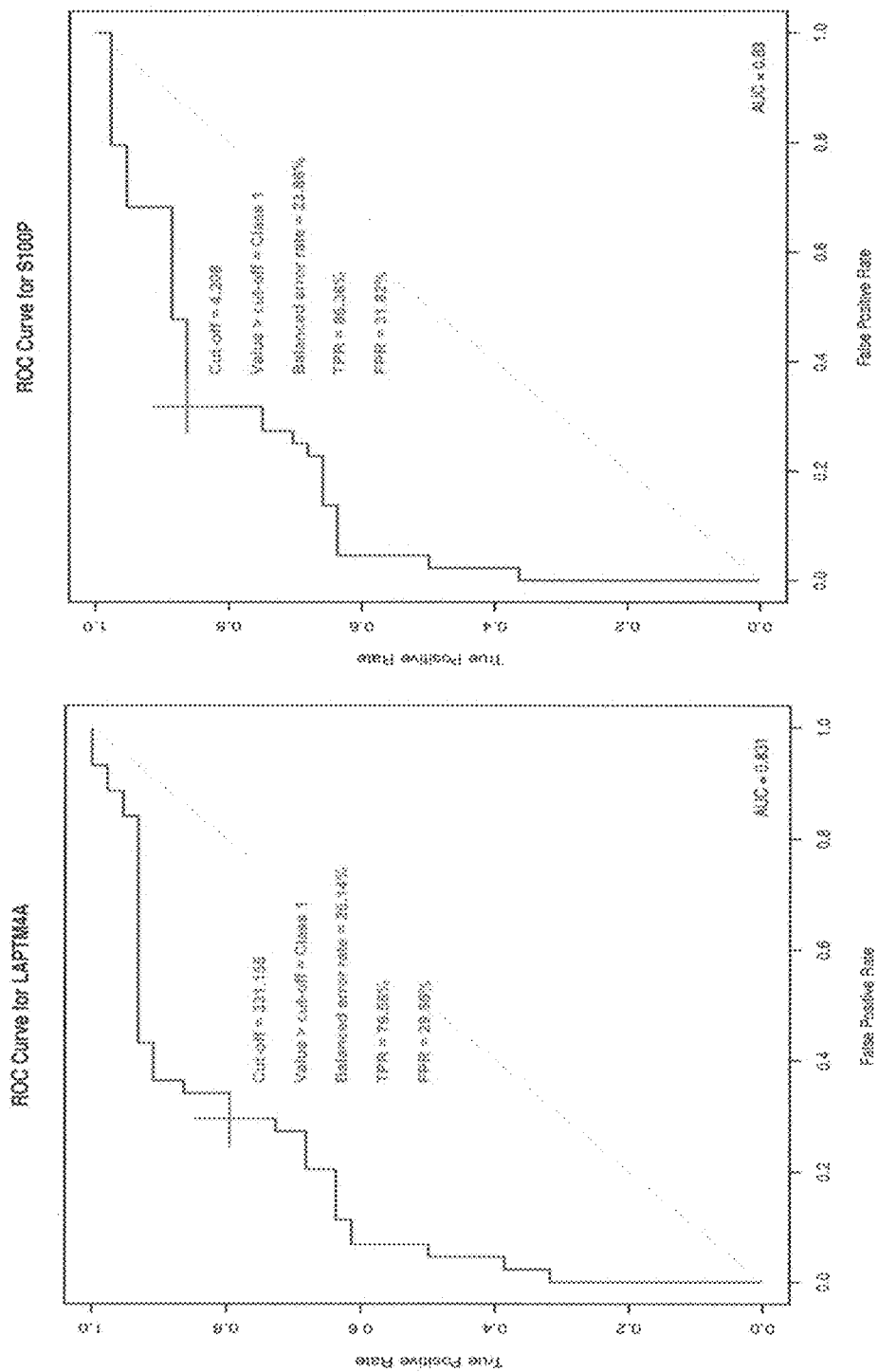
Figure 4G:
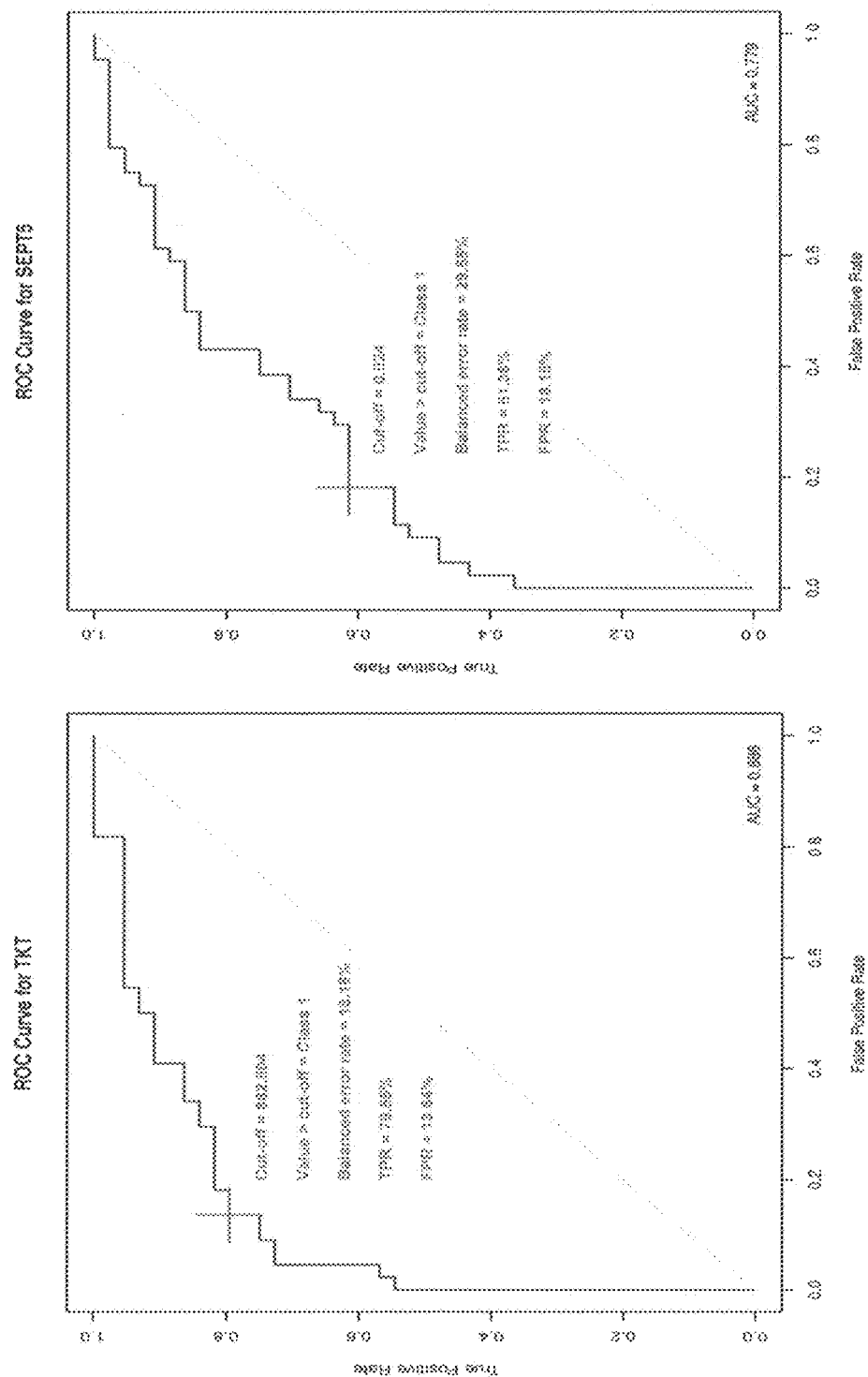

Validation of the Expression of the PBM-Associated Predictive Biomarkers During Early Stages of Tumor Development and Tumor Progression in Mouse Models of CRC To further characterize the biological role of the candidate genes, it was investigated if the human PBM gene profile can be extended to animal models of CRC. Chemically induced carcinogenesis models in Balb/c mice were used for disease follow-up from the initiation period. The azoxymethane (AOM)/dextran sulfate sodium (DSS) mouse model of colon cancers results in a predictable tumorigenesis that closely resembles the progression of the human disease (Tanaka et al., 2003). Five-week-old male Balb/c mice were injected intraperitoneally with a single dose (10 mg/kg/body weight) of the carcinogen AOM on day 1 followed by three cycles of administration of the inflammation-inducing DSS into their drinking water (3% solution) on day 1 to 5, day 22 to 26 and day 43 to 47. After this treatment, the colon of the treated mice reveals aberrant crypt foci (ACF), dysplastic lesions, adenomas and adenocarcinomas. Peripheral blood was collected and PBM were isolated by FACS using the specific mouse monocyte marker CD115 for the generation of a mouse monocyte library for CRC and gene expression studies. At the end-stage, peripheral blood was collected and the colon was subjected to histopathological evaluation (Tanaka et al., 2003). A different cohort of mice was only injected with DSS to induce chronic colitis without malignant transformation to confirm the disease specificity of the set of candidate genes in mice. As shown in FIG. 3, gene expression in mice indeed follows the same pattern as that observed in humans.

Example 4

Multicentric Validation of the Biomarker Panel

The genetic signature defined in example 1 was further confirmed in a broad test set of patient samples acquired in a multicentric trial involving a number among the major oncological centers throughout the EU: Leuven (Belgium), Brussels (Belgium), Heidelberg (Germany) and Rome (Italy). In each center, PBMs were isolated from both patients and healthy volunteers using the protocol as described in Example 1. Blood processing (isolation of monocytes) was performed within 2 hours of isolation of the peripheral blood. Lysed monocytes were stored in RLT buffer while awaiting analysis. Validation of a number of samples from the different centers (n=76 for patients and 65 for healthy subjects; matched for age, gender and ethnicity) was done i.a. using the qRT-PCR assay described in example 2, and is still ongoing for further samples. 43 genes were selected for confirmation analysis: the 29 genes listed in Table III and 14 additional markers. The list of genes is depicted in Table IV. Complete statistical analysis is still ongoing, but at least for a first set of genes evaluated in this setting, the results could be confirmed (these genes include ACP5, ADM, APP, BAX, CD68, CTSZ, CXCR4, DDIT4, FKBP5, GPER, HBA1, HBB, HP, LAPTM4A, S100P, SEPT5and TKT). Representative examples are shown in FIGS. 4A - 4G. Interestingly, and although there is inherently more variability in this data set due to the different centers and persons involved in sample gathering and monocyte isolation (which explains the slightly lower AUC-values in the ROC curves in FIGS. 4A - 4G), the data reach statistical significance when all results are combined, but also when the data are assessed center by center (e.g., comparing only patients from Leuven with healthy volunteers from Leuven). This indicates the robustness of the method, i.e., it is independent from the center were the isolation took place or the person who isolated the monocytes.

For statistical analyses between the patients (P), metastatic patients (PM) and healthy subjects (HV) groups, data sets were randomly split in a training and test set (⅔ for training, ⅓ for test set).

Two classification approaches were used: SGMV (single gene majority vote, to evaluate the contribution of single genes to the signature) and SVM (support vector machine). Also, three different quantification approaches were evaluated: absolute (i.e., copies of gene of interest per 10,000 copies of B2M), relative (each individual expression value normalized to the average of the HV group) and dCT: (delta-CT of gene of interest—reference gene).

Figure 5:
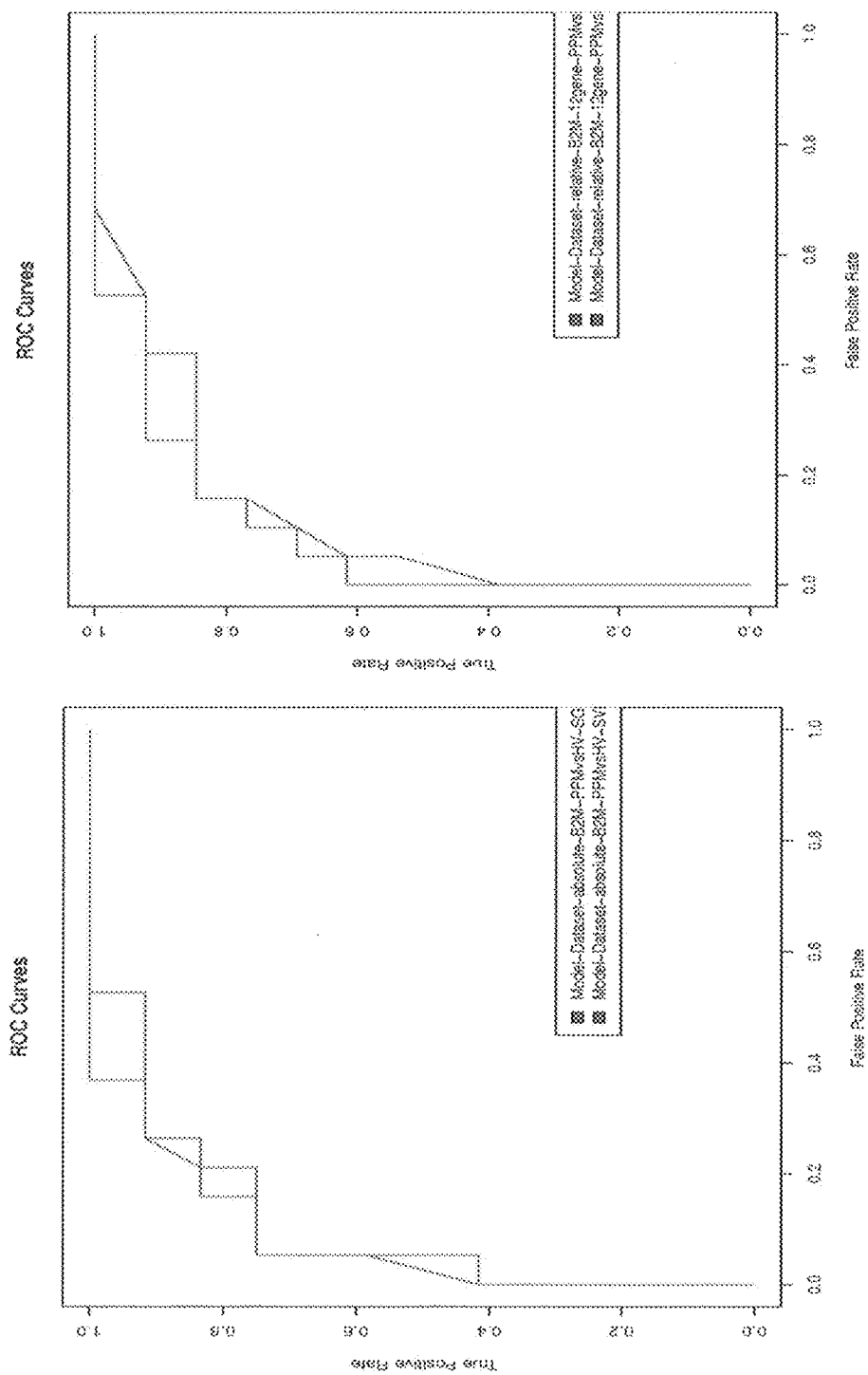
FIG. 5. ROC values for selected gene signatures from a multicenter clinical study for the combined P and PM groups vs. the HV group. Left panel shows the ROC for the combined 43 genes of Table IV, using normalization against B2M levels as described for FIGS. 4A - 4G. Red line, Single Gene Majority Vote (SGVM) classification: AUC =0.912; BER =0.204. Blue line, Support Vector Machine (SVM) classification: AUC =0.917; BER =0.151. Right panel shows the ROC for a subset of 12 genes of Table IV (ADM, BAX, CD68, CTSZ, CXCR4, FKBP5, GPER, HBA1, HBB, LAPTM4A, S100P, and TKT). Relative normalization was used (i.e., each individual expression value is normalized to the average of the HV group). Red line, SGVM classification: AUC =0.915; BER =0.156; Blue line, SVM classification: AUC =0.903, BER =0.18.

Both classifications and the three quantification approaches yield very similar results. Representative ROC values for both classification approaches are shown in FIG. 5. Interestingly, a subset of 12 genes selected from the 43 genes of Table IV (here: ADM, BAX, CD68, CTSZ, CXCR4, FKBP5, GPER, HBA1, HBB, LAPTM4A, S100P and TKT) performed equally well: there is virtually no difference in the ROC curve, AUC or BER values (compare left and right panel of FIG. 5). This indicates that, once a certain number of genes is reached to make up the signature, no sensitivity or specificity is added anymore. Also, it confirms the strength of these genes as single markers (see, e.g., also the ROC curves in FIGS. 4B- 4G) or when combining a low number of them.

Figure 6:
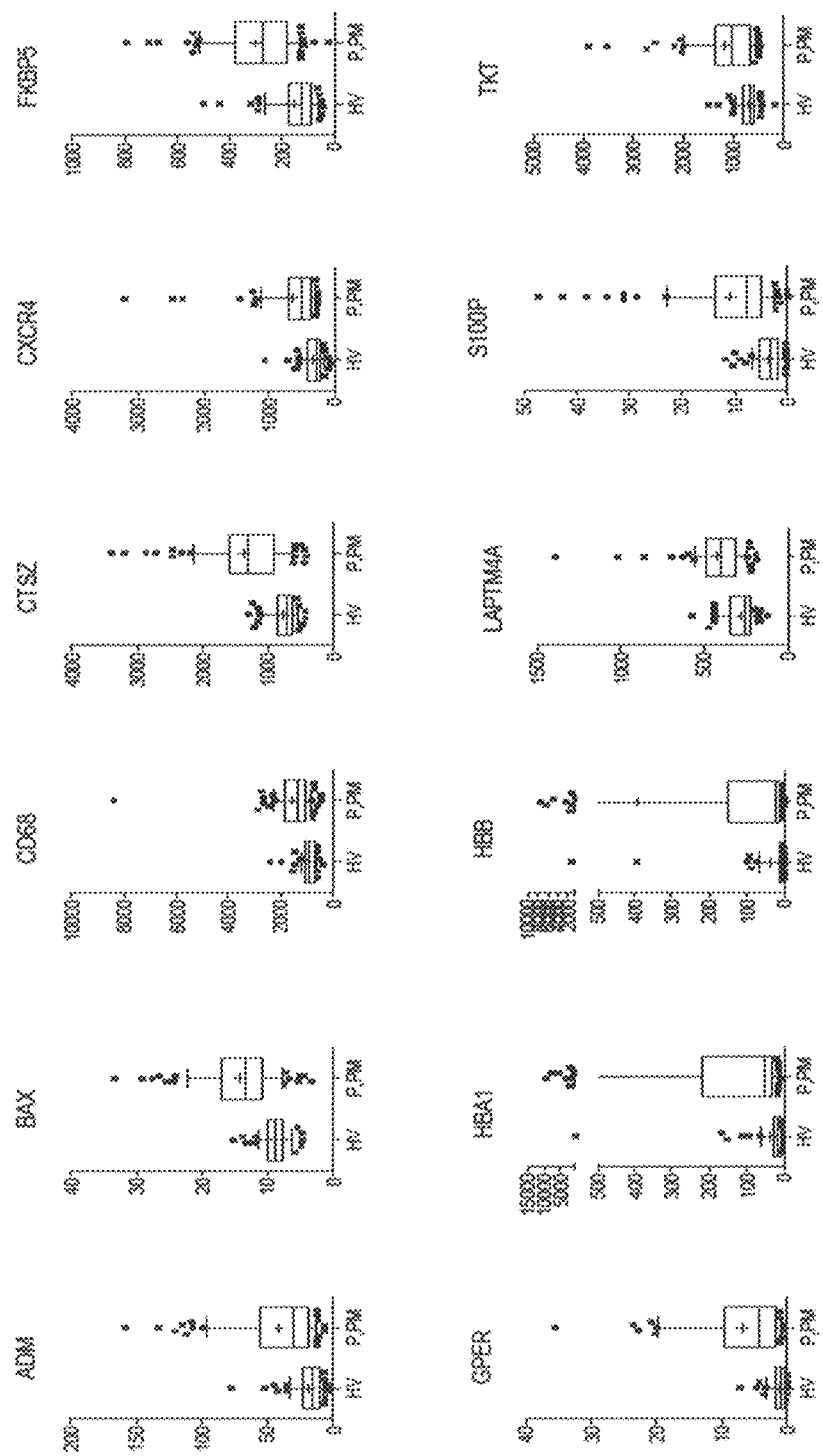
FIG. 6. mRNA expression levels for selected genes from a multicenter clinical study. Plots show mean expression values and standard error for the depicted genes. Left boxes are the HV group, right boxes are the combined P, PM groups. Normalization occurred against beta-2-microglobulin (B2M) levels, expression values are shown as copies/10 000 copies of B2M.

The expression values of the 12 genes for the subset are shown in FIG. 6.

TABLE IV

List of 43 genes evaluated in the multicentric validation experiment.

| ACP5 | ADM | APP |
| BAX | CD68 | CTSZ |
| CXCR4 | DDIT4 | FCER1A |
| FKBP5 | GPER | HBA1 |
| HBB | HP | IL1R2 |
| LAPTM4A | LOC644063 | S100P |
| SLPI | SOCS3 | TKT |
| TNF | ALDH1A1 | ARPC1B |
| CCR1 | DNAJC7 | ENSA |
| HLA-DQ1 | HLA-DRB4 | HMOX1 |
| HNRNPK | LOC100008589 | LOC10017093 |
| LOC643888 | LOC723972 | RLPL2 |
| RN28S1 | SDHC | SEPT5 |
| SLC39A1 | TAF15 | TNPO1 |
| IER2 | | |

Example 5

Assessment of a Tumor-Driven Monocyte Education Toward "Malignancy"

The entirely new and exciting concept of education of monocytes by the tumor in an endocrine manner was investigated in vitro and in vivo.

5.1 Specificity of the Signature for Colorectal Cancer Vs. Other Cancers

Figure 7:
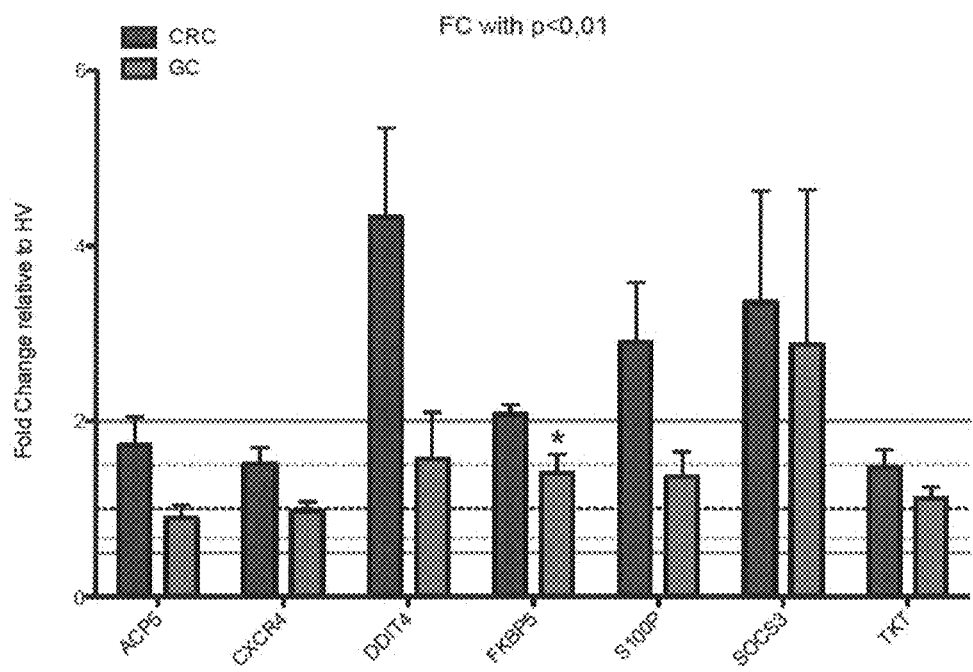
FIG. 7. Comparison of expression of selected genes in monocytes obtained from colorectal cancer patients (CRC, dark grey bars on the left) or gastric cancer patients (GC, light grey bars on the right). Expression shown as fold change relative to monocytes obtained from healthy volunteers. The genes selected all have a p value <0.01 for colorectal cancer patients. Genes significantly regulated in gastric cancer patient monocytes compared to healthy volunteers are denoted with an asterisk (p<0.05).

To evaluate whether the altered gene expression of the signature genes in monocytes is specific to colorectal cancer or a general hallmark of cancer, monocytes were also isolated from gastric cancer patients, and expression of selected genes was evaluated (FIG. 7). Remarkably, most genes that show a clear difference in expression in colorectal cancer (vs. healthy volunteers) are expressed at a similar level in gastric cancer patients and healthy volunteers (e.g., ACP5, CXCR4). Some of the genes also show an altered expression pattern, but not to the same extent as in colorectal cancer (e.g., DDIT4, FKBP5, S100P). This is a clear indication that the marker genes are specific markers for colorectal cancer and the differential expression is not due to the general presence of a tumor. Without being bound to a particular mechanism, it does make sense that colorectal cancers will secrete different factors than gastric cancers, thereby eliciting a differential response in monocytes.

Figure 8:
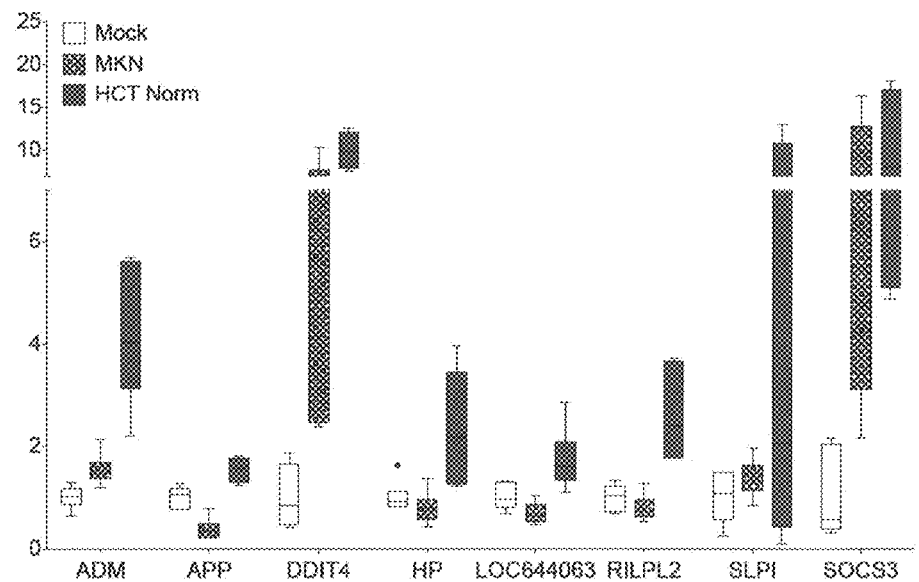
FIG. 8. Comparison of expression of selected genes in monocytes obtained from healthy volunteers cultured with normal medium (mock), medium conditioned by colorectal tumor cell line HCT116 (HCT Norm) or medium conditioned by the gastric tumor cell line MKN (MKN).

To explore this further, PBM from healthy volunteers were isolated and incubated with medium conditioned by either colorectal tumor cell line HCT116 or the gastric tumor cell line MKN (FIG. 8). As can be seen from this figure, incubation with colorectal tumor-conditioned medium induced the monocytes to alter their expression pattern to that observed in monocytes isolated from colorectal cancer patients (see also Example 5.2). Incubation with gastric tumor-conditioned medium had a smaller effect on gene expression for the genes analyzed, and the observed expression pattern is significantly different from that observed for monocytes incubated with colorectal tumor-conditioned medium (FIG. 8).

5.2 Specificity of the Signature for Cancer Versus Non-Cancerous Colon Cells.

Figure 9:
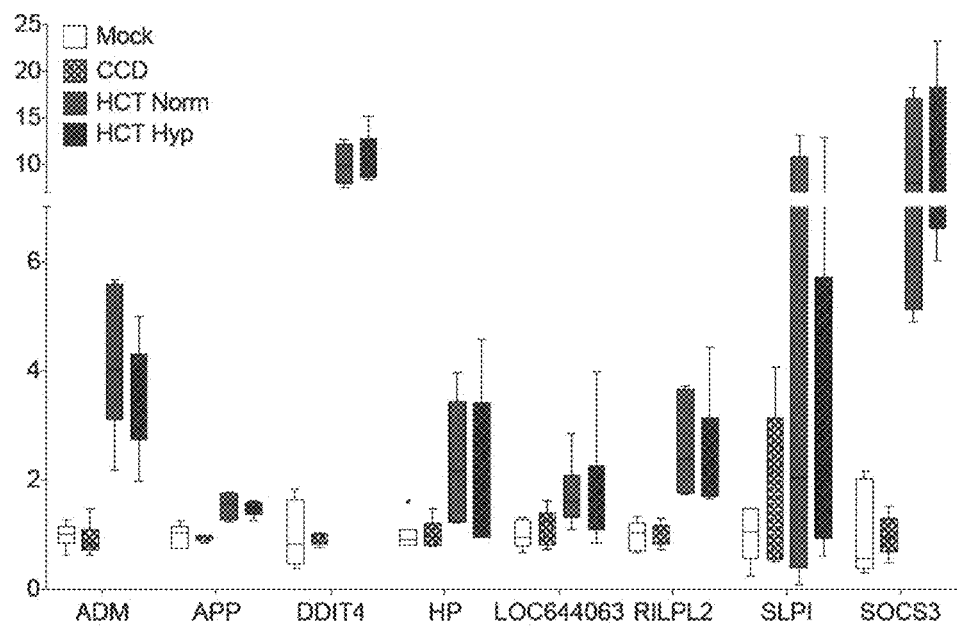
FIG. 9. Comparison of expression of selected genes in monocytes obtained from healthy volunteers cultured with normal medium, medium conditioned by a primary colonic epithelial cell line (CCD), medium conditioned by colorectal tumor cell line HCT116 in normoxic (HCT Norm) or hypoxic (HCT hyp) conditions.

In order to assess whether the altered expression pattern in monocytes is specific to the presence of a tumor or could be due to factors from the colonic epithelium, PBM from healthy volunteers were isolated and incubated for 18 hours with medium conditioned by either colorectal tumor cell line HCT116 or the benign colonic epithelial cell line CCD 841 CoN and evaluated for the expression of the set of candidate genes. A representative selection of these genes is shown in FIG. 9. Monocytes with mock medium or medium conditioned by colonic epithelial cells have a very similar expression pattern, while monocytes incubated with tumor-conditioned medium show a significant different expression pattern for these genes. Interestingly, this effect is independent from hypoxia, as there is no significant difference in expression pattern between monocytes incubated with tumor-conditioned medium in normal or hypoxic conditions. This further illustrates the specificity of the colorectal cancer gene signature of these monocytes. Moreover, this may provide an explanation why the present methods are particularly suited to detect tumors at an early stage (before they become hypoxic). Indeed, the altered gene expression is dependent on the nature of the tumor (even a small tumor), and not on the presence of hypoxia.

5.3 the Gene Signature can be Reversed In Vitro

Figure 10:
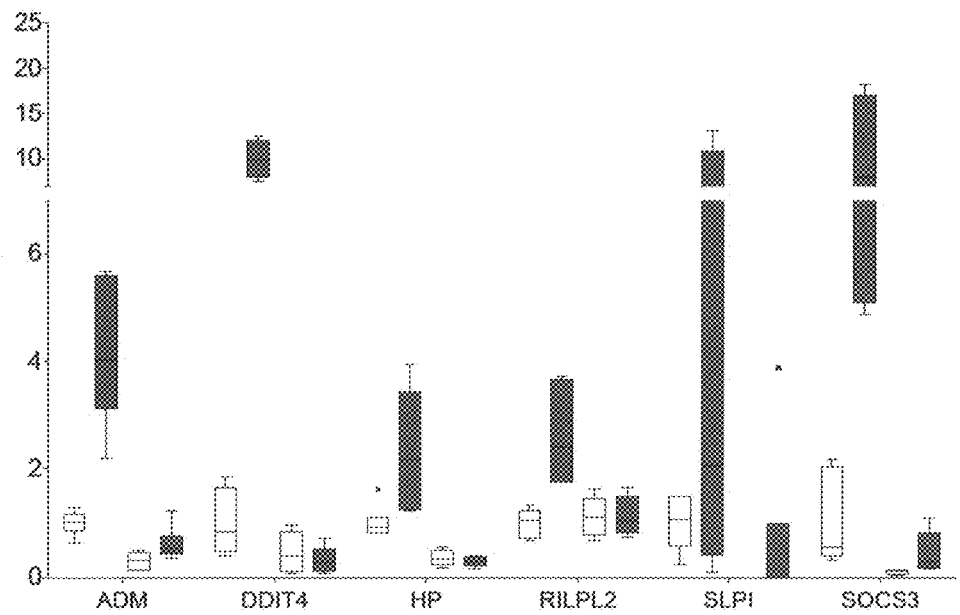
FIG. 10. Reversal of the gene signature. Monocytes from healthy volunteers were incubated with medium conditioned by a primary colonic epithelial cell line (CCD) ($1^{st}$ box and whisker, in white) or medium conditioned by colorectal tumor cell line HCT116 in normoxic conditions for 18 hours ($2^{nd}$ box and whisker, dark grey), after which the medium was refreshed to plain culture medium, and the gene signature was assessed again after 72 hours ($3^{rd}$ and $4^{th}$ box and whisker respectively, in white for the non-tumor exposed cells; in grey for the monocytes earlier exposed to HCT-conditioned medium).

We have also evaluated if the genetic signature of CRC PBM can be reversed. For this purpose, PBM from healthy volunteers were incubated with CCD or HCT-conditioned medium for 18 hours (as described in example 5.2), after which the medium was refreshed to plain culture medium, and the gene signature was assessed after 72 hours. See FIG. 10. Interestingly, the altered expression of the genes from monocytes exposed to HCT116-conditioned medium completely reverted to baseline values (i.e., those found in monocytes that have never been exposed to cancer) when no longer exposed to tumor-conditioned medium, indicating that the presence of tumor-derived factors is necessary to maintain the differential expression. This plasticity of the gene signature has important practical consequences: it makes the marker panel ideally suited to monitor both the success of therapy, and the potential recurrence of a tumor. Indeed, after, e.g., surgical resection to remove the tumor, expression of the genes described herein can be checked to see whether the tumor has indeed been completely removed, as the gene expression should return to baseline values. For follow-up, this expression can be monitored, as altered expression of these genes will indicate recurrence of the colorectal cancer. Of course, this expression can be monitored both in patients in remission wherein expression of the signature was measured during disease stage, as well as in patients wherein expression of the signature has not been evaluated before.

Example 6

Further Validation in Mouse Models

As a further follow-up, the tumor promoting potential of these educated monocytes will be investigated in vivo in a short-term four-week-long model of aberrant crypt foci formation, in which tumorigenesis is induced by weekly injection of the carcinogen AOM. By coinjecting PBM from healthy volunteers or CRC patients, respectively, in the highly immunodeficient mouse strain NOD.Cg-Prkdcscid Il2rgtm1Wjl/SzJ (The Jackson Laboratory) we will assess the tumor-promoting potential of these monocytes by analyzing the number and severity of aberrant crypt foci. Immunohistological analysis of tumor tissue and the infiltrating monocytes at different stages will reveal the interaction of the monocytes with the tumor.

REFERENCES

Allavena P., A. Sica, C. Garlanda, and A. Mantovani. The Yin-Yang of tumor-associated macrophages in neoplastic progression and immune surveillance. Immunol. Rev. 2008; 222:155-61.

Benjamini Y. and Y. Hochberg. Controlling the false discovery rate: a practical and powerful approach to multiple testing. J. R. Stat. Soc. Ser. B. 1995; 57:289-300.

Benson A. B. 3rd. Epidemiology, disease progression, and economic burden of colorectal cancer. J. Manag. Care Pharm. 2007; 13(6 Suppl. C):S5-18. Bradley A. P. The use of the area under the roc curve in the evaluation of machine learning algorithms. Pattern Recognition 1997; 30(7):1145-1159.

Burges C. J. C. A tutorial on support vector machines for pattern recognition. Data Mining and Knowledge Discovery 1998; 2(2):121-167.

Cover T. and P. Hart. Nearest neighbor pattern classification. Information Theory, IEEE Transactions on 1967; 13(1): 21-27.

Daemen A., O. Gevaert, F. Ojeda, A. Debucquoy, J. A. Suykens, C. Sempoux, J. P. Machiels, K. Haustermans, and B. De Moor. A kernel-based integration of genome-wide data for clinical decision support. Genome Med. 2009; 1(4):39.

Diaz-Uriarte R. and S. Alvarez de Andres. Gene selection and classification of microarray data using random forest. BMC Bioinformatics 2006; 7.

Dietterich T. G. Ensemble methods in machine learning. Lecture Notes in Computer Science 2000; 1857:1-15.

Eijssen L. M., P. J. Lindsey, R. Peeters, R. L. Westra, R. G. van Eijsden, M. Bolotin-Fukuhara, H. J Smeets, and R. F. Vlietinck. A novel stepwise analysis procedure of genome-wide expression profiles identifies transcript signatures of thiamine genes as classifiers of mitochondrial mutants. Yeast. 2008; 25(2):129-40.

Elkord E., P. E. Williams, H. Kynaston, and A. W. Rowbottom. Human monocyte isolation methods influence cytokine production from in vitro-generated dendritic cells. Immunology. 2005; 114(2):204-212.

Ferlay J., H. R. Shin, F. Bray, D. Forman, C. Mathers, and D. M. Parkin. Estimates of worldwide burden of cancer in 2008: GLOBOCAN 2008. Int. J. Cancer. 2010; 127(12): 2893-917.

Forssell J., A. Oberg, M. L. Henriksson, R. Stenling, A. Jung, and R. Palmqvist. High macrophage infiltration along the tumor front correlates with improved survival in colon cancer. Clin. Cancer Res. 2007; 13(5):1472-9.

Goldrosen M. H. Murine colon adenocarcinoma: immunobiology of metastases. Cancer. 1980; 45(5 Suppl.):1223-8.

Hart P. H., C. A. Jones, and J. J. Finlay-Jones. Monocytes cultured in cytokine-defined environments differ from freshly isolated monocytes in their responses to IL-4 and IL-10. J. Leukoc. Biol. 1995; 57(6):909-18.

Hurwitz H., L. Fehrenbacher, W. Novotny, T. Cartwright, J. Hainsworth, W. Heim, J. Berlin, A. Baron, S. Gritting, E. Holmgren, N. Ferrara, G. Fyfe, B. Rogers, R. Ross, and F. Kabbinavar. Bevacizumab plus irinotecan, fluorouracil, and leucovorin for metastatic colorectal cancer. N. Engl. J. Med. 2004; 350(23):2335-42.

Hwa Y. Y. and X. Yuanyuan. Identifying differentially expressed genes from microarray experiments via statistic synthesis. Bioinformatics 2005; 21(7):1084-1093.

Ikubo A., Y. Aoki, E. Nagai, and T. Suzuki. Highly metastatic variant of a mouse colon carcinoma cell line, LM17 and its response to GM-CSF gene therapy. Clin. Exp. Metastasis. 1999; 17(10):849-55.

Lewis C. E., and J. W. Pollard. Distinct role of macrophages in different tumor microenvironments. Cancer Res. 2006; 66(2):605-12.

Murdoch C., M. Muthana, S. B. Coffelt, and C. E. Lewis. The role of myeloid cells in the promotion of tumor angiogenesis. Nat. Rev. Cancer. 2008; 8(8):618-31.

Saeys Y., I. Inza, and P. Larraliaga. A review of feature selection techniques in bioinformatics. Bioinformatics. 2007; 23(19):2507-17.

Sandel M. H., A. R. Dadabayev, A. G. Menon, H. Morreau, C. J. Melief, R. Offringa, S. H. van der Burg, C. M. Janssen-van Rhijn, N. G. Ensink, R. A. Tollenaar, C. J. van de Velde, and P. J. Kuppen. Prognostic value of tumor-infiltrating dendritic cells in colorectal cancer: role of maturation status and intratumoral localization. Clin. Cancer Res. 2005; 11(7):2576-82.

Shi W., M. Bessarabova, D. Dosymbekov, Z. Derso, T. Nikolskaya, M. Dudoladova, T. Serebryiskaya, A. Bugrim, A. Guryanov, R. J. Brennan, R. Shah, J. Dopazo, M. Chen, Y. Deng, T. Shi, G. Junnan, C. Furlanello, R. S. Thomas, J. C. Corton, W. Tong, L. Shi, and Y. Nikolsky. Functional analysis of multiple genomic signatures demonstrates that classification algorithms choose phenotype-related genes. Pharmacogenomics J. 2010; 10(4):310-23.

Sickert D., D. E. Aust, S. Langer, I. Haupt, G. B. Baretton, and P. Dieter. Characterization of macrophage subpopulations in colon cancer using tissue microarrays. Histopathology. 2005; 46(5):515-21.

Sleasman J. W., B. H. Leon, L. F. Aleixo, M. Rojas, and M. M. Goodenow. Immunomagnetic selection of purified monocyte and lymphocyte populations from peripheral blood mononuclear cells following cryopreservation. Clin. Diagn. Lab. Immunol. 1997; 4(6):653-8.

Smyth G. K. Linear models and empirical bayes methods for assessing differential expression in microarray experiments. Stat. Appl. Genet. Mol. Biol. 2004; 3: Article 3.

Smyth G. K. Limma: linear models for microarray data. Springer, New York, 2005.

Statnikov A., L. Wang, and C. F. Aliferis. A comprehensive comparison of random forests and support vector machines for microarray-based cancer classification. BMC Bioinfoimatics 2008; 9:319+.

Statnikov A. and C. F. Aliferis. Analysis and computational dissection of molecular signature multiplicity. PLoS Comput. Biol. 2010; 6(5):e1000790+.

Swirski F. K., M. Nahrendorf, M. Etzrodt, M. Wildgruber, V. Cortez-Retamozo, P. Panizzi, J. L. Figueiredo, R. H. Kohler, A. Chudnovskiy, P. Waterman, E. Aikawa, T. R. Mempel, P. Libby, R. Weissleder, and M. J. Pittet. Identification of splenic reservoir monocytes and their deployment to inflammatory sites. Science. 2009; 325(5940): 612-6.

Tanaka T., H. Kohno, R. Suzuki, Y. Yamada, S. Sugie, and H. Mori. A novel inflammation-related mouse colon carcinogenesis model induced by azoxymethane and dextran sodium sulfate. Cancer Sci. 2003; 94(11):965-73.

Tibshirani R., T. Hastie, B. Narasimhan, and G. Chu. Diagnosis of multiple cancer types by shrunken centroids of gene expression. PNAS 2002; 99(10):6567-6572.

Wessels L. F., M. J. Reinders, A. A. Hart, C. J. Veenman, H. Dai, Y. D. He, and L. J. van't Veer. A protocol for building and evaluating predictors of disease state based on microarray data. Bioinformatics. 2005; 21(19):3755-62.

Yang J., S. A. Mani, J. L. Donaher, S. Ramaswamy, R. A. Itzykson, C. Come, P. Savagner, I. Gitelman, A. Richardson, and R. A. Weinberg. Twist, a master regulator of morphogenesis, plays an essential role in tumor metastasis. Cell. 2004; 117(7):927-39.

SEQUENCE LISTING (356 sequences)

SEQ ID NO: 1 - DNA, 575 bp, Homo sapiens
actcttctggtccccacagactcagagagaacccaccatggtgctgtctcctgccgacaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtagccgttcctcctgcccgctgggcctcccaacgggccctcctcccctccttgcaccggcccttcctggtctttgaataaagtctgagtgggcggc

SEQ ID NO: 2 - DNA, 626 bp, Homo sapiens
acatttgcttctgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctgggcaacgtgctggtctgtgtgctggcccatcactttggcaaagaattcaccccaccagtgcaggctgcctatcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgc

SEQ ID NO: 3 - DNA, 576 bp, Homo sapiens
actcttctggtccccacagactcagagagaacccaccatggtgctgtctcctgccgacaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtggccatgcttcttgccccttgggcctccccccagcccctcctccccttcctgcacccgtacccccgtggtctttgaataaagtctgagtgggcggc

SEQ ID NO: 4 - DNA, 1449 bp, Homo sapiens
ctggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctcccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaacc

SEQ ID NO: 5 - DNA, 2153 bp, Homo sapiens
agtacagctccggccgccgcgccgcctggctttcgtattcgttgttctcggcgggctgtggggcctccgcgccgcggccgttagtcatgtcggattctggaagttacggtcagtctgggggtgagcagcaaagttattctacctatggaaatccaggcagccaaggctatggacaagcatcacaaagctattctggctatgggcaaacgactgattcctcttatggacagaactacagcggttactccagttatggacaaagtcagtcaggttattcacagtcctatggtggttatgagaatcaaaagcagagctcatatagccagcaaccatataataaccagggacagcagcaaaacatggaatcatcaggaagccaaggtggaagagcaccttcctatgaccagccagactatggtcaacaagattcatatgaccagcagtcaggctatgatcaacatcaaggctcatatgatgagcagtcaaattatgatcagcagcatgattcctatagtcaaaaccagcagtcctatcattcacaaagggaaaactacagccaccacacacaagatgaccgtcgtgatgtgagtaggtatggagaagataatagaggatatggcgggtcacagggaggaggtagagggcgtgggggatatgacaaggatggaagaggtcctatgacaggatcaagtggtggtgaccgcggtggcttcaaaaattttggtggtcacagggattatggacccagaacagatgctgattcagaatctgataattcagataacaacacaatctttgtgcaaggacttggggagggtgtgtctacagatcaagttggggagttctttaaacaaataggaattatcaagacaaataagaagaccggaaaaccaatgataaatctttatacagacaaggacacaggaaagccaaagggggaggcaacagtgtcatttgatgaccctccttcagctaaggcagccattgactggtttgatggaaaagaattccatggcaacatcattaaagtgtcctttgccactagaagacctgaattcatgagaggaggtggaagtggaggtgggcggcgaggccgtggaggatatagaggtcgtggaggctttcaagggagaggtggagaccccaaaagtggggattgggtttgccctaatccgtcatgcggaaatatgaactttgctcgaaggaattcctgcaatcagtgcaatgagcctagaccagaggactctcgtccctcaggaggagatttccgggggagaggctacggtggagagaggggctacagaggtcgtgggggcagaggtggagaccgaggcggctatggtggagacagaagtgggggtggctatggtggagacagaagcagcggtggtggctacagcggagatagaagtgggggcggctatggtggagacagaagtgggggtggctatggtggggacagaggcggcggctatggtggggacagaggaggcggctatggaggagaccgaggaggtggctatggaggagatcgaggtggctatggaggagaccgaggtggaggctatggtggagaccgaggaggctatggaggagatcgaggaggttacggaggagatcgaggaggttatggaggagatcgaggaggctatggaggagacagaagccgggggggctatggaggagaccgtggtggtggcagtggctacggtggagaccgaagtggaggctatggaggagacaggagtggtggcggctatggaggagaccgaggtgggggctacggaggagaccgaggtggctatggaggcaaaatgggaggaagaaacgactacagaaatgatcagcgcaaccgaccatactgatgactgttttgaatgttcctttgtctctgacatgatccatagtgaaattgccagagttttgcctgctgctttcctcgtggcctcttcttgggtagtgaaattaagtgacatttggatttttatttgggtgggagggctgggacagtttttcttctagaaatgtctgttgagatttccccctttagtttccaaccttctccccaacccttggagctaaatgcgttgtaaaatattgccaaaatgaaaagtgttttgtaatactgcaataaaggctgcttgtttttgtgg

SEQ ID NO: 6 - DNA, 1501 bp, Homo sapiens
ggggtcggccgggtgctaggccggggccgaggccgaggccggggcgggatccagagcgggagccggcgcgggatctgggactcggagcgggatccggagcgggacccaggagccggcgcggggccatggcgaggcgcgggccagggtggcggccgcttctgctgctcgtgctgctggcgggcgcggcgcagggcggcctctacttccgccggggacagacctgctaccggcctctgcggggggacgggctggctccgctggggcgcagcacatacccccggcctcatgagtacctgtccccagcggatctgcccaagagctgggactggcgcaatgtggatggtgtcaactatgccagcatcacccggaaccagcacatcccccaatactgcggctcctgctgggcccacgccagcaccagcgctatggcggatcggatcaacatcaagaggaagggagcgtggccctccaccctcctgtccgtgcagaacgtcatcgactgcggtaacgctggctcctgtgaagggggtaatgacctgtccgtgtgggactacgcccaccagcacggcatccctgacgagacctgcaacaactaccaggccaaggaccaggagtgtgacaagtttaaccaatgtgggacatgcaatgaattcaaagagtgccacgccatccggaactacaccctctggagggtgggagactacggctccctctctgggagggagaagatgatggcagaaatctacgcaaatggtcccatcagctgtggaataatggcaacagaaagactggctaactacaccggaggcatctatgccgaataccaggacaccacatatataaaccatgtcgtttccgtggctgggtggggcatcagtgatgggactgagtactggattgtccggaattcatggggtgaaccatggggcgagagaggctggctgaggatcgtgaccagcacctataaggatgggaagggcgccagatacaaccttgccatcgaggagcactgtacatttggggaccccatcgtttaaggccatgtcactagaagcgcagtttaagaaaaggcatggtgacccatgaccagaggggatcctatggttatgtgtgccaggctggctggcaggaactggggtggctatcaatattggatggcgaggacagcgtggtactggctgcgagtgttcctgagagttgaaagtgggatgacttatgacacttgcacagcatggctctgcctcacaatgatgcagtcagccacctggtgaagaagtgacctgcaacacaggaaacgatgggacctcagtcttcttcagcagaggacttgatattttgtatttggcaactgtgggcaataatatggcatttaagaggtgaaagagttcagacttatcaccattcttatgtcactttagaatcaagggtgggggagggagggagggagttggcagtttcaaatcgcccaagtgatgaataaagtatctggctctgcacgaga

SEQ ID NO: 7 - DNA, 2166 bp, Homo sapiens
agtacagctccggccgccgcgccgcctggctttcgtattcgttgttctcggcgggctgtggggcctccgcgccgcggccgttagtcatgtcggattctggaagttacggtcagtctgggggtgagcagcaaagttattctacctatggaaatccaggcagccaaggctatggacaagcatcacaaagctattctggctatgggcaaacgactgattcctcttatggacagaactacagcggttactccagttatggacaaagttattcacagtcctatggtggttatgagaatcaaaagcagagctcatatagccagcaaccatataataaccagggacagcagcaaaacatggaatcatcaggaagccaaggtggaagagcaccttcctatgaccagccagactatggtcaacaagattcatatgaccagcagtcaggctatgatcaacatcaaggctcatatgatgagcagtcaaattatgatcagcagcatgattcctatagtcaaaaccagcagtcctatcattcacaaagggaaaactacagccaccacacacaagatgaccgtcgtgatgtgagtaggtatggagaagataatagaggatatggcgggtcacagggaggaggtagagggcgtgggggatatgacaaggatggaagaggtcctatgacaggatcaagtggtggtgaccgcggtggcttcaaaaattttggtggtcacagggattatggacccagaacagatgctgattcagaatctgataattcagataacaacacaatctttgtgcaaggacttggggagggtgtgtctacagatcaagttggggagttctttaaacaaataggaattatcaagacaaataagaagaccggaaaaccaatgataaatctttatacagacaaggacacaggaaagccaaagggggaggcaacagtgtcatttgatgaccctccttcagctaaggcagccattgactggtttgatggaaaagaattccatggcaacatcattaaagtgtcctttgccactagaagacctgaattcatgagaggaggtggaagtggaggtgggcggcgaggccgtggaggatatagaggtcgtggaggctttcaagggagaggtggagaccccaaaagtggggattgggtttgccctaatccgtcatgcggaaatatgaactttgctcgaaggaattcctgcaatcagtgcaatgagcctagaccagaggactctcgtccctcaggaggagatttccgggggagaggctacggtggagagaggggctacagaggtcgtgggggcagaggtggagaccgaggcggctatggtggagacagaagtgggggtggctatggtggagacagaagcagcggtggtggctacagcggagatagaagtgggggcggctatggtggagacagaagtgggggtggctatggtggggacagaggcggcggctatggtggggacagaggaggcggctatggaggagaccgaggaggtggctatggaggagatcgaggtggctatggaggagaccgaggtggaggctatggtggagaccgaggaggctatggaggagatcgaggaggttacggaggagatcgaggaggttatggaggagatcgaggaggctatggaggagacagaagccgggggggctatggaggagaccgtggtggtggcagtggctacggtggagaccgaagtggaggctatggaggagacaggagtggtggcggctatggaggagaccgaggtgggggctacggaggagaccgaggtggctatggaggcaaaatgggaggaagaaacgactacagaaatgatcagcgcaaccgaccatactgatgactgttttgaatgttcctttgtctctgacatgatccatagtgaaattgccagagttttgcctgctgctttcctcgtggcctcttcttgggtagtgaaattaagtgacatttggatttttatttgggtgggagggctgggacagtttttcttctagaaatgtctgttgagatttccccctttagtttccaaccttctccccaacccttggagctaaatgcgttgtaaaatattgccaaaatgaaaagtgttttgtaatactgcaataaaggctgcttgtttttgtggaaaaaaaaaaaaaaaaaaaaaa

SEQ ID NO: 8 - DNA, 1752 bp, Homo sapiens
agggcgcagcaggccaagggggaggtgcgagcgtggacctgggacgggtctgggcggctctcggtggttggcacgggttcgcacacccattcaagcggcaggacgcacttgtcttagcagttctcgctgaccgcgctagctgcggcttctacgctccggcactctgagttcatcagcaaacgccctggcgtctgtcctcaccatgcctagcctttgggaccgcttctcgtcgtcgtccacctcctcttcgccctcgtccttgccccgaactcccaccccagatcggccgccgcgctcagcctgggggtcggcgacccgggaggaggggtttgaccgctccacgagcctggagagctcggactgcgagtccctggacagcagcaacagtggcttcgggccggaggaagacacggcttacctggatggggtgtcgttgcccgacttcgagctgctcagtgaccctgaggatgaacacttgtgtgccaacctgatgcagctgctgcaggagagcctggcccaggcgcggctgggctctcgacgccctgcgcgcctgctgatgcctagccagttggtaagccaggtgggcaaagaactactgcgcctggcctacagcgagccgtgcggcctgcggggggcgctgctggacgtctgcgtggagcagggcaagagctgccacagcgtgggccagctggcactcgaccccagcctggtgcccaccttccagctgaccctcgtgctgcgcctggactcacgactctggcccaagatccaggggctgtttagctccgccaactctcccttcctccctggcttcagccagtccctgacgctgagcactggcttccgagtcatcaagaagaagctgtacagctcggaacagctgctcattgaggagtgttgaacttcaacctgagggggccgacagtgccctccaagacagagacgactgaacttttggggtggagactagaggcaggagctgagggactgattcctgtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgaaggaagaggcacgtgctcctcagagcagccggagggaggggggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaacagtt

SEQ ID NO: 9 - DNA, 482 bp, Homo sapiens
tcgcgaaggcccgcggcgggtgttgatgcgatgtgatttctgcccagtgctctgaatgtcaaagtgaagaaattcaatgaagcgcgggtaaacggcaggagtaactatgactctcttaaggtagccaaatgcctcgtcatctaattagtgaggcgcatgaatggatgaacgagattcccactgtccctacctactatccagcgaaaccacagccaagggaacggacttggcggaatcagcggggaaagaagactctgttgagcttgactctagtctggcacggtgaagagacgtgagaggtgtagaataagtgggaggcccccggcgccccccggtgtccccgcgaggggtccagggcggggtctgccggccctgcgggccgccggtgaaataccactactctgatcgttttttcactgacccggtgaggcgggggggcgagccctgaggggctctcgcttctggcgccaagcgcccggccg

SEQ ID NO: 10 - DNA, 5763 bp, Homo sapiens
gcgcaaggcacctgctggcaatggcaggaggcggacgtggggggtcgtgcagtaggtactggagggagagacgtgggcacaaaggtcgcgggaggaacaggtgcccacaatggctgcatatttgcccgtggatcactgaagattcctgctctcctgctgaggtggagactgcagtgagctgagatcgcaccattgcactccagcctgggcaacgagtgcaaaactcagtctccagataaaaaaaagaaaaagaaaaaaaagaggccgggtgtggtggcttatgcctatgatcctagcactttgggaggtcggggtggacggatcacgagatcaggagttggaggccagcctggccaacatagtgaaagcccgtctctagtaaaaatacaaaatttagtcagacatggtgggcaggagagagcatgtgcaggggaacatccatttataaaaccatcagacctcatgagacttattcactaccatgagaacagcatgggggaaactgcctccatgattcagttatctccacctggccccacccttgacacatgggaattgttacaattcaagatgagatttgggtgcggacagagccaaaccatataattcttccccggcccctcccaaatctcatgtcctcatatttcaaaagcaatcatgccttcccctaagtcccccaaactcttatttcagcattaactcaaaattccatagtccaaagtctcatctgagacaaggcaagtcccttccacctatgagcctgtaaaatcaaaagcaagttagttattttctagatacacagggatacaggcattgggtaaatacactcgtttcaaatgggagaaattggccaaagcgaaagagctacaggccccatgcaagtccaaaacccagcaggcaaatcttaaagctccaaaatgacctcctttgactccatgtgtcacatctaggtgatgcaagaagtgggttcccagggtcttgggcagccccgcccctgtggctttgcagggtacagccccccttctggctgcattgagtgtctgcagcttttccaggcacacagtgcaagctgtcagtggatctaccattctggggtctggaggatggtggcccttttctcacagctctgcttggcagtaccccagtggggactctgtgtgggagctccaaccccatatttccctttgacactgtcctagcagaggttatccatgagggcccccccctcccctcccccccacagcaaacttttgcctggatttccaggcattttcatacatcttctgaaatgtaggcggaggttcatgaacgttaattcttgactttggtgcatctgcaggcttaacaccacctagaacctgaaaggcttggaacttgcaccctctgaagccatggcctgaggtgtaccttggccccttttacctatggcaggagcagctgggatgcagggccccaagttcctaggctgcacacagcagggggttctggacccacaaaaccatttttccttctaagcctcctggcctgtgatgggagggtctgctgtgagggtctctaacatgccctggagacatttgccccattgtcttggtgattaacatttggctcctcattacttatgcaaatttctacaacccagtctcctgagaaaatagatttttcttttctgttgcatcatcaggctacaaattttctgaacttttatgctctgcttcttctcgaatgctttgctgcttagaaatttcttctgtcagataccttcaatcatctctctcaagttcaaagttccacagatctgtagggaactctagaaagaaattcttattttccctctttcccgcctatcttatgcccgtttctaatacaggtgcacaatgcctgcagtgtctttgcatagtaagagtgactttactccatttcccaacaaattcctcatctccctctgagaccacctccgcctggaccttgttgtccatatcactattaacattttggtcaaagccattcaacaagtctctaggaagttccaaactttcccacattttcctatcctcttctgagccttccaaactgttccagcctctccctgttacccatttccaaagttgcttccacattttcgggtatctttacagcagcaccccactctactggtatcaacttattgtattagtctgttctcacaccgcaaataaagacatacctgagactgggtaatttataaaggaaagaggttgaattgactcacagttctgcatggctggggaggcctcacaatcatggtggaaggcaaggaggtgcaaaagcatgtctcacatagtggcaggcaggagagagcatgtgcaggggagctcccatttataaaaccatcagatctcatgagacttagtcactaccgcgagaacagtatggggggaaccatccccatgattcagttatctgcacccggccccacccttgacacgtgggaattattacaatgcaagggctggtgaattaccagatctccgtcaagtgcagtaaccagttcaagttggaagtgtgtcttttgaatgcagaaaacaaagtcgtggacaaccaggctgggacccagggccagctgaaggtgctgggtgccaacctctggtggccgtacctgatgcacgaacaccccgcctacctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtagggtttcaccaggatccacctctgatgttcagtgaagaggaccggaaaagtctgctagagcagtaccatctgggtctggatcaaaaacgcagaaaatacgtggttggagagctcatctggaattttgccgatttcatgactaaccagtccaaggatgaaggaaaaactggacctcattatggatttacttttgggatacactcattattccagaggagggtaaaaggctgagaagcttaagacttgctataattctgtgagagagctataaaagtctgctcagaaacattataacgtaaaatggacagagaaggacaatgagatatttaatttgccacggcaaagccattgctgtgaagaatggataatatatgtcaatggtaatatatgaagaaataacacagatggagctggcttgaaatcctcttgtttatggcagtacatatcgtttatgattcaaaaaatatagcccatttccaaaaacctgcaacaaagagatactttctcaggtgtcagtttcttggtcgggaatgaaaatagtgccaacctgtgataccttcactctaattttactttctgaggaagttttctgtaatagttatttggtgataattattaatactggtgagaaaatcaatgtaaaagaggagaaataacccacacaaccacatacaactaggaaatgatagatggatctgaaaaaaaaggatatgcactcttaacaagttcaacacccaagtactattgcaagtaccagctgtatttcatggaaaaaaaaaaaagaataactcaaaaggcagaacgaagagcctagaggtcagagatgagaggcatgaataattattcacaggcgttgaatataatcaaatgacttgcaacatttaccactgggattttaaaatgtggtggaccaatcattcttttagtctgtgcattttcccatttttttcaacaggaatgtctagagacattattcctgttttgccactgtatttttggtgaatgtgtagtaagtaactggcctctttagtatcacaaagctggatgaagaaaatgtggtacatatacaccatgaaatactatgccgccacaaaaaggaaatgagatcatgtcctctgcagggacatggatgaagctggaagccattatccttagcaaagtaacgcaggaacagaaaaccaaacaccacatgttgtctcttagaagtgggagctgaacgatgggctttgcagagattaaagcttcagaaaaaaatatgggaaaatatgttaaaatgttgacctgaaaatgaagtggatgactataaaactcttgagagaattagactttttgtagcagtttattacatgataataccttaaaggagatcacattcagtgacctgcgttgacagatgtgaatttcttcggagtaagaaatcctcagaggaaattacccagtatattcaaagctacaagggatttgttgacataacggtaatgtataacagcaatttttttctcaagtttttggattacctgtaagtgtctgactcagaagggcataggcattctttttatgtcatgggtttgatttctttcttcctttctcctttcattcccctggctcccatcttcaaagtgaaaaatatcacattcacttgctgacctagagcctttttctttttccagggctggcttctgacgggctctgcttgccttcctgatagtcttcccctttatgaatgaagccacttgccccagcttccctctgctgcccctatctgcaggcttgctaagatctcctgacctaggcgctgtcacccacagtgggctgcagagctggctcttcctagctggctaactatcctgaatcagtaaaaatttcctagtggagagtgatgggaaatcgaatccaaactggcttaaacaaaaatgagaatttattgattaacatgactcaggagaccagaactctatagagaacatggcctgacagtgggggaagagaggtgtttcctcaaaaagaaactgggtgcagctttcccagaagaatcagttgctcaatatataataccctgatgaatttagttaccattctatgtctcttacttcctcattcgtcaaagtacatctgtgatatttaaatgcaggtctgttttcaaggtcagtttccggaaacagtgaccctgagaaggcttcctcctgagtatgcataaacattcacagcttgcatgcgtgtgtgtgtgtgtgtgtgtgtgtgtgtgtatgtttgcttgcactgcataaaaacaattgcaacatcaacagaaataaaaattaaaggaataattctcctccgactctgccgttccatccagtgaaactcttcattctggggtaaagttccttcagttcttgttcatagataggtatatacttcataagtcaaacaatcaggctgggcgcagtagctcatgcctgtaatcccagccctttgggaggccgagctgggcagatcacttgagatcaggtgttcgagaccagcctcaagacctccaacatgggccgggtgcagtggctcacgtctgtaatcccagcactttgggaggccgagacggacggatgatgaggtcaggagatagagaccatcctggctaacatggtgaaaccccatctctactaaaaatacaaaaaaaaaaaaaaattagcccggcatggtggcaggcgcctgtggtcccagctactcgggaggctgaggcaggagaatggcgtgaacctgggaggcagagcttgtagtgagccaagtgccactgtgctccagcctggacgacagagcgagactctgtctcaaaaaaaaaaaaaaagaaaaaaaaaaaaaaaa

SEQ ID NO: 11 - DNA, 3781 bp, Homo sapiens
gggccggctcgcgggcgctgccagtctcgggcggcggtgtccggcgcgcgggcggcctgctgggcgggctgaagggttagcggagcacgggcaaggcggagagtgacggagtcggcgagcccccgcggcgacaggttctctacttaaaagacaatgactactgatgaaggtgccaagaacaatgaagaaagccccacagccactgttgctgagcagggagaggatattacctccaaaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaagatatggttttggagaggcagggaagcctaaatttggcattgaacctaatgctgagcttatatatgaagttacacttaagagcttcgaaaaggccaaagaatcctgggagatggataccaaagaaaaattggagcaggctgccattgtcaaagagaagggaaccgtatacttcaagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggcccttggactggacagtgccaatgagaaaggcttgtataggaggggtgaagcccagctgctcatgaacgagtttgagtcagccaagggtgactttgagaaagtgctggaagtaaacccccagaataaggctgcaagactgcagatctccatgtgccagaaaaaggccaaggagcacaacgagcgggaccgcaggatatacgccaacatgttcaagaagtttgcagagcaggatgccaaggaagaggccaataaagcaatgggcaagaagacttcagaaggggtcactaatgaaaaaggaacagacagtcaagcaatggaagaagagaaacctgagggccacgtatgacgccacgccaaggagggaagagtcccagtgaactcggcccctcctcaatgggctttcccccaactcaggacagaacagtgtttaatgtaaagtttgttatagtctatgtgattctggaagcaaatggcaaaaccagtagcttcccaaaaacagcccccctgctgctgcccggagggttcactgaggggtggcacgggaccactccaggtggaacaaacagaaatgactgtggtgtggagggagtgagccagcagcttaagtccagctcatttcagtttctatcaaccttcaagtatccaattcagggtccctggagatcatcctaacaatgtggggctgttaggttttacctttgaactttcatagcactgcagaaaccttttaaaaaaaaatgcttcatgaatttctcctttcctacagttgggtagggtaggggaaggaggataagcttttgttttttaaatgactgaagtgctataaatgtagtctgttgcatttttaaccaacagaacccacagtagaggggtctcatgtctccccagttccacagcagtgtcacagacgtgaaagccagaacctcagaggccacttgcttgctgacttagcctcctcccaaagtccccctcctcagccagcctccttgtgagagtggctttctaccacacacagcctgtccctgggggagtaattctgtcattcctaaaacacccttcagcaatgataatgagcagatgagagtttctggattagcttttcctattttcgatgaagttctgagatactgaaatgtgaaaagagcaatcagaattgtgctttttctcccctcctctattccttttagggaataatattcaatacacagtacttcctcccagcattgctactgctcagcttcttctttcattctaatccttgctattaagaatttaagacttgtgcttacaatatttttgacctggagtggatctatttacatagtcatttaggatccatgcagctttttttgtctttttaagattattggctcataagcatatgtatactggtttatggaactttatttacactcctctatcatgcaaaaaaattttgactttttagtactaagcttaatttttaaaaacaaaatctgtagtgttgacaaataaatagttgctcttctacactaggggtttcacctgcaggtttgacacgcagttgctcgcttttcctgccctgtcaagcttctctgttctggcgtgagttgtgaaagagttgaagacagcttcccatgccggtacacagccagtagcctaaatctccagtacttgagctgaccattgaactagggcaagtcttaaatgtgtacatgtagttgaatttcagtccttacgggtaaacagattgagcatggctctctattccctcagcctaagaaacactcatgggaatgcatttggcaacccaaggaaccatttgcttaaacctggaacatctcacctttttaaatcctaaaaaacactggcagttatattttaaattagtttttatttttatgatggttttatcaaaagacttttattattagattgggacccccttcaaacctaaaaatcaagttatttccttttataatacttttcttccccatggaacaaatgggatcaatttgtgagttttttcctttaatgataactaaaatccctctaatttctcatttatgcttttgtcttttttatgaaatatttcttttaaaagccccagtctcacctacgaaatatgaagagcaaaagctgattttgcttacttgctaaactgttgggaaagctctgtagagcatggttccagtgaggccaagattgaaatttgatactaaaaaggccacctagctttttgcagataacaaacaagaaagctattccaagactcagatgatgccagctgtctcccacgtgtgtattatggttcaccagggggaactggcaaaagtgtgtgtggggaggggaagggtgtgtgagtggttctgagcaaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattgtttttaaaaaaaaaaaatcatttagatgcacttttttgtgtgttctttaaataaatccaaaaaaaatgtgaaaaaaaaaa

SEQ ID NO: 12 - DNA, 490 bp, Homo sapiens
ttttttaatgatcatcaacgtagttttttattaataaaatgaaaataataagatgaggaataatgataatgacagacaaatatgggagtgcacgcacaccaaaggtctttttccaaaccccagccttccactctgtccaccttcctgacctttaatacacaacccagcccctgttcccttctgaaatcccaagcttttcaaaatgactcaaagataccgagattgagggcgaggagctgaggatgtgtggaatagggtggggctggaactccagacctggacctgtattatatttgcaaaggaggcaaatataacccagaaaggctagggaagatggcagcagaggaatgagaaaagctgaaggatggaaaatgtaaaaaatgaggacagaaagaggagttgaggaaagccagccaagaatagagggccaggtgcctgactcagataagacaagagcagggttgtctgggaaagatagggaaagagacca

SEQ ID NO: 13 - DNA, 1756 bp, Homo sapiens
cggctgccgcggagtgcgatgtggtaatggcggcgaccgagccggagctgctcgacgaccaagaggcgaagagggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaaggttgttttctgcatggaccgtgccctagaatttgcccctgcctgccatcgcttcaaaatcctcaaggcagaatgtttagcaatgctgggtcgttatccggaagcacagtctgtggctagtgacattctacgaatggattccaccaatgcagatgctctgtatgtacgaggtctttgcctttattacgaagattgtattgagaaggcagttcagtttttcgtacaggctctcaggatggctcctgaccacgagaaggcctgcattgcctgcagaaatgccaaagcactcaaagcaaagaaagaagatgggaataaagcatttaaggaaggaaattacaaactagcatatgaactgtacacagaagccctggggatagaccccaacaatataaaaacaaatgctaaactctactgtaatcggggtacggttaattccaagcttaggaaactagatgatgcaatagaagactgcacaaatgcagtgaagcttgatgacacttacataaaagcctacttgagaagagctcagtgttacatggacacagaacagtatgaagaagcagtacgagactatgaaaaagtataccagacagagaaaacaaaagaacacaaacagctcctaaaaaatgcgcagctggaactgaagaagagtaagaggaaagattactacaagattctaggagtggacaagaatgcctctgaggacgagatcaagaaagcttatcggaaacgggccttgatgcaccatccagatcggcatagtggagccagtgctgaggttcagaaggaggaggagaagaagttcaaggaagttggagaggcctttactatcctctctgatcccaagaaaaagactcgctatgacagtggacaggacctagatgaggagggcatgaatatgggtgattttgatccaaacaatatcttcaaggcattctttggcggtcctggcggcttcagctttgaagcatctggtccagggaatttcttttttcaatttggctaatgaagggcaaccacccagaacccagaaaatgcagattcactcagtttaatcttgaatgtggaaacagttcacctcctcccttcatcacgtctccgtgtgcttagagcagtttcgttttctcagttggatgccctgtgtctctgtgagtggggtggagcaaagggaaccaatgccgaagaccgagggcaggggagggaggcgggggtggacagggaggcagcttgtgaatttttgttttactgtttaactttattaaaaaagaaaaaaaaaaaaaa

SEQ ID NO: 14 - DNA, 2981 bp, Homo sapiens
gcattactcatactcagcggacaaaggatcactcagcattcaatctcaccacttcaaaacattacagagggaaaacgacacctagaagtaggagtgagattcgctgaagttcccttctgaggaagacccacccctccgcctggagagccggggctggcggtgcctgaggaccccttcggcctggacagcccacgcgggcttggggggcctcgctctgccctcatggggcggccatcggttcccgaagcggcgagtgaaaattcaaatggccagtagggggcgcactcggaagtggccgccccgcatgaggcagttcagcggccccgagagtccggggagggaggtttattctccgcctgcacgagactgtgaaatccgcaaccatgagcaggagaggcggccctggtggggaagaggccaccaacatctggacggcagccctgctcaggcattcggcaggtccagcagaggtacacctcctgcagcgggttccaagtgcacctccagcctgatgggcctgaccaaggaggcttccaggagcacagaaggggctgcaacccaggtacccagagagtgagcagctccacgcgggactgtgcacggtggccgacacccgcagggacgcccgccggacgagcacgcggagggccctcgcctccacggatgcaccatgccggtgtgaggagcatctgttcttcccactctctgcagttaacaaacccaacccaaaccaccacaggtgctcctcctggggagtttcctgtctgacaaatgccaggctcacttcaaggagaatcacgcttctttctaaagatggattcaccatttaaaacagagctctgggagcctttcggcaaatcttgaaagctgcacggtgcagagacatggatgtgacttcccaagcccggggcgtgggcctggagatgtacccaggcaccgcgcagcctgcggcccccaacaccacctcccccgagctcaacctgtcccacccgctcctgggcaccgccctggccaatgggacaggtgagctctcggagcaccagcagtacgtgatcggcctgttcctctcgtgcctctacaccatcttcctcttccccatcggctttgtgggcaacatcctgatcctggtggtgaacatcagcttccgcgagaagatgaccatccccgacctgtacttcatcaacctggcggtggcggacctcatcctggtggccgactccctcattgaggtgttcaacctgcacgagcggtactacgacatcgccgtcctgtgcaccttcatgtcgctcttcctgcaggtcaacatgtacagcagcgtcttcttcctcacctggatgagcttcgaccgctacatcgccctggccagggccatgcgctgcagcctgttccgcaccaagcaccacgcccggctgagctgtggcctcatctggatggcatccgtgtcagccacgctggtgcccttcaccgccgtgcacctgcagcacaccgacgaggcctgcttctgtttcgcggatgtccgggaggtgcagtggctcgaggtcacgctgggcttcatcgtgcccttcgccatcatcggcctgtgctactccctcattgtccgggtgctggtcagggcgcaccggcaccgtgggctgcggccccggcggcagaaggcgctccgcatgatcctcgcggtggtgctggtcttcttcgtctgctggctgccggagaacgtcttcatcagcgtgcacctcctgcagcggacgcagcctggggccgctccctgcaagcagtctttccgccatgcccaccccctcacgggccacattgtcaacctcgccgccttctccaacagctgcctaaaccccctcatctacagctttctcggggagaccttcagggacaagctgaggctgtacattgagcagaaaacaaatttgccggccctgaaccgcttctgtcacgctgccctgaaggccgtcattccagacagcaccgagcagtcggatgtgaggttcagcagtgccgtgtagacagccttggccgcataggcccagccagggtgtgactcgggagctgcacacacctgggtggacacaaggcacggccacgtcatgtctctaaactgcggtcagatgtggcttctggctcctcggggcctcgcgagggtcacgcttgcctggtcaccctggggctgcttaggaaacctcacgactggtcaccttgcactcctcacacagaattgctacaatcccaaagcgctcgccccgcagggtccaaaggccagcggtgaccagcctgtcacccagctcctccccgccaaccctgcctgccgctgcacctgcctgccgctgcaggaaacatttctgacaccgtcgaccaggaaagccacacggagaggccactgtgggtgaagcgcctcagttacacaggaaccctaaagcaaatctgccaccgtgggggaactgacgctggagatgcaaggtgctggtgggtctgagctggacgtcgcggtgtgtcctctgtgcccacggtctgagctagctagcgcaccgccgagttaaagaggagaaggaaaacatgctgctctggtgcacgcctgagcgtcctccatcttccaggatggcagcaatggcgctgtgcggcctcaccaggcccacgaggagcagcagcgctcggcccggagcagcaggaaggcccctctgtggagcgcccgccgtctgctccggggtggttcagtcactgcttgttgacatcaacatggcaattgcactcatgtggactgggaccgtgcgagctgccgtgtgggttagtcgggtgccaggacaatgaaatactccagcacctgtggctgacgaatttgtttctacagaaataacagctggggacaactgcggtgatgatgtaaaaaccttcccataaaatgtaagaaaagctgatgaggctggtgacgttcagcctttgtcaataaacctgtcatgtgcggatccttaaaaaaaaaa

SEQ ID NO: 15 - DNA, 3525 bp, Homo sapiens
ggagcgggcggcggcggcggcggcgcggaggggccgctcaccccgcagcccggcctcggcctccgccgcttgtcgtcgcgccccgcccgcgagcccgccccgcacgtcccccgccggcggccaccatgagcacaggcctgcggtacaagagcaagctggcgaccccagaggacaagcaggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaaggagagcgcgcccttcgccgttataggcagcaacacggtggtggaggccaaggggcagcgggtccggggccgactgtacccctgggggatcgtggaggtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaactgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtcgcagcgggtgtccgagtgctccgtgtgcccctgagagcgggtgggagcggaagcctgagcggcctgcggcctccggcgatagtgtgctatctgccgctgcagcgcgcgtccgcgcggcctctgggctatttctggccaggccgcagcactgtggtcggtgcgggcgtggcaggggcggggcggccttatcgctcggctctcccgcctacgcctcccgctgcagagtaagccgggctgccgtcttctcgccatgggctccggtgagtctggagtccggtcgggcccccggctgctccctaggccgacccgggttgagaggagctctggtcgtttggctgcagctgggagagacttgggtcagacttagaggggacttccagccggcgtgcggggtggtcagggtggagaggctggcgggctaccgggacgccgggcatcaggggctggatggagccgggccggcagtctgggtactcagagatgtcgcccaggtgcccgccgaccgctcggcttactgcggcgcttcccttgcagggccgcgcggggcgctgagcttactgctcctgctgctggccccgccgagccgcccggccgcaggttgcccggcgccctgtagctgcgcggggacgctcgtggactgcgggcgccgcgggctgacttgggcctcgctgccgaccgccttccctgtcgacacaaccgagctggtgctgaccggcaacaacctgacggcgctgccgccggggctgctggacgcgctgcccgcgctgcgcaccgcacacctgggcgccaacccctggcgctgcgactgccgccttgtgccgctgcgcgcctggctggccggccgccccgagcgtgcgccctaccgcgacctgcgttgcgtggcgcccccagcgctgcgcggccgcctgctgccctatctggccgaggacgagctgcgcgccgcttgcgctcccggcccgctctgctggggggcgctggcggcgcagcttgcgctgctgggccttgggctgctgcacgcgttgctgctggtgctgctgctgtgccgcctgcggaggctgcgggcccgggcccgcgctcgcgccgcagcccggctgtcgctgaccgacccgctggtggccgagcgagccggaaccgacgagtcctgaggagagaaccggtgcgtcctgaggagagaaccggcgctgggcaacacgggcctgcaaactcgacaggaccctgcccgaggggccctcgcgccaacctggaccggtccccgcctcctccgctgcccaatctctcagacccaccccacctgcaggcccagaccacgtgggacagaactcctgcccaccctaccccgagggaggcgaacccgcacttccaggcttgggaggaccatggggcacaatgcggtccagaccctgctgcgtctcccttccaaactctggtgctgaataaacccttctgatctggtct

SEQ ID NO: 16 - DNA, 2038 bp, Homo sapiens
atggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaacctcgtggccattctagacatcaatcgcctgggccagagtgacccggcccctctgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacattaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaaaaaaaaaaaaaaaaaaaaaaaaaaaaaaaaaaaaaaaaaaaaaaaaaaaaaaaaaaaa

SEQ ID NO: 17 - DNA, 1557 bp, Homo sapiens
ctttcactgctctttaagctcccccagcagagtggagaggtctgttttcccttgtttggattcctagaggcagcacaggccaaacacaaggtcatcactaaggaagtgtgcacaggatgaacgcggtgggtgctgtttaagggaagggtaaagcctttaaagggtaaagggctgagagaaggagcagagagtgtgtttggggtggaggcacccaggaggagtccgtgcaggctgcggtgctggacggatcctcctccagctcctgcttagaggtctccagaaccggctggaggcagggagggggtcccaaaagccttgggatcagaaggggttttcccgcctggtcccccagaccccccgttcgcctcaggaagacggaggatgagcctctgggctgcgcgtggtcggggttatggttgggatcagttaaggttccagtgccagcaccccgcccagggagccccggatggtggcgtctctgttagtgtcttccccggaggccgcccctgtgaccggatccttcgtgtccccacagcacgtttcttgaagcaggataagtttgagtgtcatttcttcaacgggacggagcgggtgcggtatctgcacagaggcatctataaccaagaggagaacgtgcgcttcgacagcgacgtgggggagtaccgggcggtgacggagctggggcggcctgtcgccgagtcctggaacagccagaaggacttcctggagcggaggcgggccgaggtggacaccgtgtgcagacacaactacggggttggtgagagcttcacagtgcagaggcgagtccatcctgaggtgactgtgtatcctgccaagactcagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcggagtggagaagtttacacctgccaagtggagcacccaagtgtgatgagccctctcacagtggaatggagagcacggtctgaatctgcacagagcaagatgctgagtggagtcgggggctttgtgctgggcctgctcttccttggggccgggttgttcatctacttcaggaatcagaaaggacactctggacttcagccaacaggattcctgagctgaagtgaagatgaccacattcaaggaaaaaccttccgccccagctttgcaggatgaaacacttccccgcttggctctcattcttccacaagagagacctttctccggacctggttgctactggttcagcaactctgcagaaaatgtcctcccctgtggctgcctcagctcatgcctttggcctgaagtcccagcattgatggcagcccctcatcttccaagttttgtgctcccctttacctaacgcttcctgcctcccatgcatctgtactcctcctgtgccacaaacacattacattattaaatgtttctcaaacatggagt

SEQ ID NO: 18 - DNA, 5035 bp, Homo sapiens
cgcgacctcagatcagacgtggcgacccgctgaatttaagcatattagtcagcggaggaaaagaaactaaccaggattccctcagtaacggcgagtgaacagggaagagcccagcgccgaatccccgccccgcggggcgcgggacatgtggcgtacggaagacccgctccccggcgccgctcgtggggggcccaagtccttctgatcgaggcccagcccgtggacggtgtgaggccggtagcggccggcgcgcgcccgggtcttcccggagtcgggttgcttgggaatgcagcccaaagcgggtggtaaactccatctaaggctaaataccggcacgagaccgatagtcaacaagtaccgtaagggaaagttgaaaagaactttgaagagagagttcaagagggcgtgaaaccgttaagaggtaaacgggtggggtccgcgcagtccgcccggaggattcaacccggcggcgggtccggccgtgtcggcggcccggcggatctttcccgccccccgttcctcccgacccctccacccgccctcccttcccccgccgcccctcctcctcctccccggagggggcgggctccggcgggtgcgggggtgggcgggcggggccgggggtggggtcggcgggggaccgtcccccgaccggcgaccggccgccgccgggcgcatttccaccgcggcggtgcgccgcgaccggctccgggacggctgggaaggcccggcggggaaggtggctcggggggccccgtccgtccgtccgtcctcctcctcccccgtctccgccccccggccccgcgtcctccctcgggagggcgcgcgggtcggggcggcggcggcggcggcggtggcggcggcggcgggggcggcgggaccgaaaccccccccgagtgttacagcccccccggcagcagcactcgccgaatcccggggccgagggagcgagacccgtcgccgcgctctcccccctcccggcgcccacccccgcggggaatcccccgcgaggggggtctcccccgcgggggcgcgccggcgtctcctcgtgggggggccgggccacccctcccacggcgcgaccgctctcccacccctcctccccgcgcccccgccccggcgacggggggggtgccgcgcgcgggtcggggggcggggcggactgtccccagtgcgccccgggcgggtcgcgccgtcgggcccgggggaggttctctcggggccacgcgcgcgtcccccgaagagggggacggcggagcgagcgcacggggtcggcggcgacgtcggctacccacccgacccgtcttgaaacacggaccaaggagtctaacacgtgcgcgagtcgggggctcgcacgaaagccgccgtggcgcaatgaaggtgaaggccggcgcgctcgccggccgaggtgggatcccgaggcctctccagtccgccgagggcgcaccaccggcccgtctcgcccgccgcgccggggaggtggagcacgagcgcacgtgttaggacccgaaagatggtgaactatgcctgggcagggcgaagccagaggaaactctggtggaggtccgtagcggtcctgacgtgcaaatcggtcgtccgacctgggtataggggcgaaagactaatcgaaccatctagtagctggttccctccgaagtttccctcaggatagctggcgctctcgcagacccgacgcacccccgccacgcagttttatccggtaaagcgaatgattagaggtcttggggccgaaacgatctcaacctattctcaaactttaaatgggtaagaagcccggctcgctggcgtggagccgggcgtggaatgcgagtgcctagtgggccacttttggtaagcagaactggcgctgcgggatgaaccgaacgccgggttaaggcgcccgatgccgacgctcatcagaccccagaaaaggtgttggttgatatagacagcaggacggtggccatggaagtcggaatccgctaaggagtgtgtaacaactcacctgccgaatcaactagccctgaaaatggatggcgctggagcgtcgggcccatacccggccgtcgccggcagtcgagagtggacgggagcggcgggggcggcgcgcgcgcgcgcgcgtgtggtgtgcgtcggagggcggcggcggcggcggcggcgggggtgtggggtccttcccccgcccccccccccacgcctcctcccctcctcccgcccacgccccgctccccgcccccggagccccgcggacgctacgccgcgacgagtaggagggccgctgcggtgagccttgaagcctagggcgcgggcccgggtggagccgccgcaggtgcagatcttggtggtagtagcaaatattcaaacgagaactttgaaggccgaagtggagaagggttccatgtgaacagcagttgaacatgggtcagtcggtcctgagagatgggcgagcgccgttccgaagggacgggcgatggcctccgttgccctcggccgatcgaaagggagtcgggttcagatccccgaatccggagtggcggagatgggcgccgcgaggcgtccagtgcggtaacgcgaccgatcccggagaagccggcgggagccccggggagagttctcttttctttgtgaagggcagggcgccctggaatgggttcgccccgagagaggggcccgtgccttggaaagcgtcgcggttccggcggcgtccggtgagctctcgctggcccttgaaaatccgggggagagggtgtaaatctcgcgccgggccgtacccatatccgcagcaggtctccaaggtgaacagcctctggcatgttggaacaatgtaggtaagggaagtcggcaagccggatccgtaacttcgggataaggattggctctaagggctgggtcggtcgggctggggcgcgaagcggggctgggcgcgcgccgcggctggacgaggcgcgcgccccccccacgcccggggcacccccctcgcggccctcccccgccccacccgcgcgcgccgctcgctccctccccaccccgcgccctctctctctctctctcccccgctccccgtcctcccccctccccgggggagcgccgcgtgggggcgcggcggggggagaagggtcggggcggcaggggccgcgcggcggccgccggggcggccggcgggggcaggtccccgcgaggggggccccggggacccggggggccggcggcggcgcggactctggacgcgagccgggcccttcccgtggatcgccccagctgcggcgggcgtcgcggccgcccccggggagcccggcggcggcgcggcgcgccccccacccccaccccacgtctcggtcgcgcgcgcgtccgctgggggcgggagcggtcgggcggcggcggtcggcgggcggcggggcggggcggttcgtccccccgccctacccccccggccccgtccgccccccgttcccccctcctcctcggcgcgcggcggcggcggcggcaggcggcggaggggccgcgggccggtcccccccgccgggtccgcccccggggccgcggttccgcgcgcgcctcgcctcggccggcgcctagcagccgacttagaactggtgcggaccaggggaatccgactgtttaattaaaacaaagcatcgcgaaggcccgcggcgggtgttgacgcgatgtgatttctgcccagtgctctgaatgtcaaagtgaagaaattcaatgaagcgcgggtaaacggcgggagtaactatgactctcttaaggtagccaaatgcctcgtcatctaattagtgacgcgcatgaatggatgaacgagattcccactgtccctacctactatccagcgaaaccacagccaagggaacgggcttggcggaatcagcggggaaagaagaccctgttgagcttgactctagtctggcacggtgaagagacatgagaggtgtagaataagtgggaggcccccggcgcccccccggtgtccccgcgaggggcccggggcggggtccgcggccctgcgggccgccggtgaaataccactactctgatcgttttttcactgacccggtgaggcgggggggcgagcccgaggggctctcgcttctggcgccaagcgcccgcccggccgggcgcgacccgctccggggacagtgccaggtggggagtttgactggggcggtacacctgtcaaacggtaacgcaggtgtcctaaggcgagctcagggaggacagaaacctcccgtggagcagaagggcaaaagctcgcttgatcttgattttcagtacgaatacagaccgtgaaagcggggcctcacgatccttctgaccttttgggttttaagcaggaggtgtcagaaaagttaccacagggataactggcttgtggcggccaagcgttcatagcgacgtcgctttttgatccttcgatgtcggctcttcctatcattgtgaagcagaattcgccaagcgttggattgttcacccactaatagggaacgtgagctgggtttagaccgtcgtgagacaggttagttttaccctactgatgatgtgttgttgccatggtaatcctgctcagtacgagaggaaccgcaggttcagacatttggtgtatgtgcttggctgaggagccaatggggcgaagctaccatctgtgggattatgactgaacgcctctaagtcagaatcccgcccaggcgaacgatacggcagcgccgcggagcctcggttggcctcggatagccggtcccccgcctgtccccgccggcgggccgcccccccctccacgcgccccgccgcgggagggcgcgtgccccgccgcgcgccgggaccggggtccggtgcggagtgcccttcgtcctgggaaacggggcgcggccggaaaggcggccgccccctcgcccgtcacgcaccgcacgttcgtggggaacctggcgctaaaccattcgtagacgacctgcttctgggtcggggtttcgtacgtagcagagcagctccctcgctgcgatctattgaaagtcagccctcgacacaagggtttgtc

SEQ ID NO: 19 - DNA, 1433 bp, Homo sapiens
agatgccccacagcactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtatacaccttaaatgataagaagcagtggataaataaggctgttggagataaacttcctgaatgtgaagcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccattt

SEQ ID NO: 20 - DNA, 1010 bp, Homo sapiens
ggctggtgaattaccagatctccgtcaagtgcagtaaccagttcaagttggaaggtgtgtcttttgaatgcagaaaacaaagtcgtggacaaccaggctgggacccagggccagctgaaggtgctgggtgccaacctctggtggccgtacctgatgcacgaacaccccgcctacctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtagggtttcaccaggatccacctctgatgttcagtgaagaggaccggaaaagtctgctagagcagtaccatctgggtctggatcaaaaacgcagaaaatacgtggttggagagctcatctggaattttgccgatttcatgactaaccagtgtgtcagtttcttggtcgggaatgaaaatagtgccaacctgtgataccttcactctaattttactttctgaggaagttttctgtaatagttatttggtgataattattaatactgatgtgaatttcttcggagtaagaaatcctcagaggaaattacccagtatattcaaagctacaagggatttgttgacataacggtctgttttcaaggcagtttccggaaacagtgaccctgagaaggcttcctcctgagtatgcataaacattcacagcttgcatgcgtgtgtgtgtgtgtgtgtgtgtgtgtgtgtatgtttgcttgcactgcataaaaacaattgcaacatcaacagaaataaaaattaaaggaataattctcctccgactctgccgttccatccagtgaaactcttcattctggggga

SEQ ID NO: 21 - DNA, 1550 bp, Homo sapiens
tcaacgcctgcctcccctcgagcgtcctcagcgcagccgccgcccgcggagccagcacgaacgagcccagcaccggccggatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccagctctttgaggagttgcaggagctgctgacccatgacaccaaggaccagagcccctcacgggcaccagggcttcgccagcgggccagcaacaaagtgcaagattctgcccccgtggagactcccagagggaagcccccactcaacacccgctcccaggctccgcttctccgatgggtccttacactcagctttctggtggcgacagttgctgtagggctttatgccatgtgaatgcaggcatgctggctcccagggccatgaactttgtccggtggaaggccttctttctagagagggaattctcttggctggcttccttaccgtgggcactgaaggctttcagggcctccagccctctcactgtgtccctctctctggaaaggaggaaggagcctatggcatcttccccaacgaaaagcacatccaggcaatggcctaaacttcagagggggcgaaggggtcagccctgcccttcagcatcctcagttcctgcagcagagcctggaagacaccctaatgtggcagctgtctcaaacctccaaaagccctgagtttcaagtatccttgttgacacggccatgaccactttccccgtgggccatggcaatttttacacaaacctgaaaagatgttgtgtcttgtgtttttgtcttatttttgttggagccactctgttcctggctcagcctcaaatgcagtatttttgttgtgttctgttgtttttatagcagggttggggtggtttttgagccatgcgtgggtggggagggaggtgtttaacggcactgtggccttggtctaacttttgtgtgaaataataaacaacattgtctg

SEQ ID NO: 22 - DNA, 510 bp, Homo sapiens
tgaggctgccttataaagcaccaagaggctgccagtgggacattttctcggccctgccagcccccaggaggaaggtgggtctgaatctagcaccatgacggaactagagacagccatgggcatgatcatagacgtcttttcccgatattcgggcagcgagggcagcacgcagaccctgaccaagggggagctcaaggtgctgatggagaaggagctaccaggcttcctgcagagtggaaaagacaaggatgccgtggataaattgctcaaggacctggacgccaatggagatgcccaggtggacttcagtgagttcatcgtgttcgtggctgcaatcacgtctgcctgtcacaagtactttgagaaggcaggactcaaatgatgccctggagatgtcacagattcctggcagagccatggtcccaggcttcccaaaagtgtttgttggcaattattcccctaggctgagcctgctcatgtacctctgattaataaatgcttatgaaatga

SEQ ID NO: 23 - DNA, 482 bp, Homo sapiens
tcgcgaaggcccgcggcgggtgttgatgcgatgtgatttctgcccagtgctctgaatgtcaaagtgaagaaattcaatgaagcgcggtaaacggcaggagtaactatgactctcttaaggtagccaaatgcctcgtcatctaattagtgaggcgcatgaatggatgaacgagattcccactgtccctacctactatccagcgaaaccacagccaagggaacggacttggcggaatcagcggggaaagaaggccctgttgagcttgactctagtctggcacggtgaagagacgtgagaggtgtagaataagtgggaggcccccggcgccccccggtgtccccgcgaggggtccagggcgggatctgccggccctgcgggccgctggtgaaataccactactctgatcgttttttcactgacccggtgaggcggggggggggggcgagccctgaggggctctcgcttctggcgccaagcgcccg

SEQ ID NO: 24 - DNA, 2445 bp, Homo sapiens
aggagagtcaggccaatggggccgcagttctttcttttttttttctttattcttatttttggagacagggtctcgctctgttgcccaggctggagtgcggtggtgcgatcacggttccatgcagcccccgacctcccgggctcaggtgattctcccgcctcagcaccgcgagcagctaggaccacaggcgcgagccactgcgtccggccggcgggacttatttgtcaggcggggattgggttccgccagcctaaagggaggggtaagcgccagaatatgaatcgccgggaagctgggagaaagctccgggaaaccctgagcagccaggtcgcctgctccgcccgctcccgctcccgatctctgattgctcctaactgacgtcactcccggtctgtccccgcccactcggtgctgccattggcagtcggtcgtgggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctagaaaaaaaaaaaaaaaaaaa

SEQ ID NO: 25 - DNA, 472 bp, Homo sapiens
aaggaaaggtggtcattctgatgatcgatgactcacctgtccagctaatggctagcctgtcatgccatgacctgacccacactcagagcagagggtaccctaatgtggccacagcaaattccaggcagtagggagctgttttaaggtgaataagacacagtcttctccatcattaacccccaaagtctggtgagagatacagactgacatagtatgagaggtgttgagatggagcacagagaccacagagagaaggctggccatgtggaacagacctcagagaagctgcttacaggaggcaacatctaagttaattttgaagaattagaaacagttttccagatggagagactggaaaacacatgctacagagaaagaatgtgctcaaagatccaggattgcaagaaacacttaaaacctcttcatcttgaagccccatctcattttaaaccgaatataaatacatacatag

SEQ ID NO: 26 - DNA, 2746 bp, Homo sapiens
ggctccgacttggactccctgctccgctgctgccgcttcggccccgcacgcagccagccgccagccgcccgcccggcccagctcccgccgcggccccttgccgcggtccctctcctggtcccctcccggttggtccgggggtgcgcagggggcagggcgggcgcccaggggaagctcgagggacgcgcgcgcgaaggctcctttgtggacttcacggccgccaacatctgggcgcagcgcgggccaccgctggccgtctcgccgccgcgtcgccttggggacccgagggggctcagccccaaggacggagacttcgattcgggaccagccccccgggatgcggtagcggccgctgtgcggaggccgcgaagcagctgcagccgccgccgcgcagatccacgctggctccgtgcgccatggtcacccacagcaagtttcccgccgccgggatgagccgccccctggacaccagcctgcgcctcaagaccttcagctccaagagcgagtaccagctggtggtgaacgcagtgcgcaagctgcaggagagcggcttctactggagcgcagtgaccggcggcgaggcgaacctgctgctcagtgccgagcccgccggcacctttctgatccgcgacagctcggaccagcgccacttcttcacgctcagcgtcaagacccagtctgggaccaagaacctgcgcatccagtgtgaggggggcagcttctctctgcagagcgatccccggagcacgcagcccgtgccccgcttcgactgcgtgctcaagctggtgcaccactacatgccgccccctggagccccctccttcccctcgccacctactgaaccctcctccgaggtgcccgagcagccgtctgcccagccactccctgggagtccccccagaagagcctattacatctactccgggggcgagaagatccccctggtgttgagccggcccctctcctccaacgtggccactcttcagcatctctgtcggaagaccgtcaacggccacctggactcctatgagaaagtcacccagctgccggggcccattcgggagttcctggaccagtacgatgccccgctttaaggggtaaagggcgcaaagggcatgggtcgggagaggggacgcaggcccctctcctccgtggcacatggcacaagcacaagaagccaaccaggagagagtcctgtagctctggggggaaagagggcggacaggcccctccctctgccctctccctgcagaatgtggcaggcggacctggaatgtgttggagggaagggggagtaccacctgagtctccagcttctccggaggagccagctgtcctggtgggacgatagcaaccacaagtggattctccttcaattcctcagcttcccctctgcctccaaacaggggacacttcgggaatgctgaactaatgagaactgccagggaatcttcaaactttccaacggaacttgtttgctctttgatttggtttaaacctgagctggttgtggagcctgggaaaggtggaagagagagaggtcctgagggccccagggctgcgggctggcgaaggaaatggtcacaccccccgcccaccccaggcgaggatcctggtgacatgctcctctccctggctccggggagaagggcttggggtgacctgaagggaaccatcctggtaccccacatcctctcctccgggacagtcaccgaaaacacaggttccaaagtctacctggtgcctgagagcccagggcccttcctccgttttaagggggaagcaacatttggaggggatggatgggctggtcagctggtctccttttcctactcatactataccttcctgtacctgggtggatggagcgggaggatggaggagacgggacatctttcacctcaggctcctggtagagaagacaggggattctactctgtgcctcctgactatgtctggctaagagattcgccttaaatgctccctgtcccatggagagggacccagcataggaaagccacatactcagcctggatgggtggagaggctgagggactcactggagggcaccaagccagcccacagccagggaagtggggagggggggcggaaacccatgcctcccagctgagcactgggaatgtcagcccagtaagtattggccagtcaggcgcctcgtggtcagagcagagccaccaggtcccactgccccgagccctgcacagccctccctcctgcctgggtgggggaggctggaggtcattggagaggctggactgctgccaccccgggtgctcccgctctgccatagcactgatcagtgacaatttacaggaatgtagcagcgatggaattacctggaacagttttttgtttttgtttttgtttttgtttttgtgggggggggcaactaaacaaacacaaagtattctgtgtcaggtattgggctggacagggcagttgtgtgttggggtggtttttttctctatttttttgtttgtttcttgttttttaataatgtttacaatctgcctcaatcactctgtcttttataaagattccacctccagtcctctctcctcccccctactcaggcccttgaggctattaggagatgcttgaagaactcaacaaaatcccaatccaagtcaaactttgcacatatttatatttatattcagaaaagaaacatttcagtaatttataataaagagcactattttttaatgaaaaaaaaaaaaaaaaa

SEQ ID NO: 27 - DNA, 849 bp, Homo sapiens
tcacgtgacccgggcgcgctgcggccgcccgcgcggacccggcgagaggcggcggcgggagcggcggtgatggacgggtccggggagcagcccagaggcggggggcccaccagctctgagcagatcatgaagacaggggcccttttgcttcagggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttggaccgtgaccatctttgtggcgggagtgctcaccgcctcactcaccatctggaagaagatgggctgaggcccccagctgccttggactgtgtttttcctccataaattatggcatttttctgggaggggtggggattgggggacatgggcatttttcttacttttgtaattattggggggtgtggggaagagtggtcttgagggggtaataaacctccttcgggacacaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28 - DNA, 270 bp, Homo sapiens
aagagaggctgaagatggaagagggcagaggatggagaaacaattaaggagttatgatcataatttccttcagagatgatgaagacacaaactcattcaacacgaattgagataaacaggaagaaataaaactgagattgaagtagagactgcataatgaccttgagaacagggagtataagagagaaagaaggttagttgcttttaatcaatgaaagataagactttcacctcacttcactgaaatagacttggatgtctacttggata

SEQ ID NO: 29 - DNA, 738 bp, Homo sapiens
atggagatgggcagacggattcatttagagctgcggaacaggacgccctctgatgtgaaagaacttgtcctggacaacagtcggtcgaatgaaggcaaactcgaaggcctcacagatgaatctgaagaactggaattcttcagtgcaaccaacgtaggcctcacctcaactgcaaacttaccgaagttaaacaaacttaagaagcttgaactaagcgataacagagtctcggggggcgtggaagcattggcagaaaagtgtccgaacctcacgcatctaaatttatgtggcaacaaaattaaagacctcagcacaacagagccactgaaaaacctagaaaacctcaagagcttagaccttttcaattgcgaggtaaccaacctgaacgactaccgagaaaatgtgttcaagctcctcctgcaactcacatatcttgacggctatgaccgggacgacaaggaggcccctaacttggatgctgagggctacgtggagggcctggatgaggaggaggaggatgaggatgaggaggagtatgacgaagatgctcaggtagtggaggacgaggaggaggaggaaggtgaagaggaggacgtgagtggagaggaggaggaggatgaaaaaggttataacgatggagaggttgatgatgaggaagatgaagaagagctccgtgaagaagaaaggggtcagaagcgaaaaggagaacctgaagatgagggagaagatgatgactaa

SEQ ID NO: 30 - DNA, 2453 bp, Homo sapiens
gcctcatttttcccggctcctatttaagatggagttgctctggttcacacacctctgacatgatcattgcccactgcggcttccacctcccgggttcaagagatcctcctgcctcaccctcccaaggtgctgggactacaggtgtgtgccaccagctcagctaatttttgtattttttgtagagatggtgtttttccatgttgcccaggctggtctcaaactcctgggctcaagcaatccttctgtctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttaagacagagtttcgctcttgttgcccaggctggagtgcagtggcacgatctcagctcaccacaacctccgcctcccaggttcaagcgattctcctgcctcagcctcccgagtagctgggattacaggcatgtaccaccacgcccgggtaattttgtatttttagtagagacggggggtttctccatgttggtcaggctggtctagaactccagacctcaggtgatacccctgcctcagcctcccaatgtgctgggattacagctgtgaagccaccgcgcccggctgctgtgatagttgagatgtaaaccaaaaataaaattctaagccacccagtccgactgaatggacccttcctgttgagcaaggacattccaaagtaaactgaaaagaccagcttaggccatgatgggaaggggaggtgtcaacatgcctcattctaccttcctccctctggaatccagacacaactgaccagcattaacattaaaacagagatcttaagctgggcacagtggctcatgcctataatcccagcactttgggaggccaaggtgggatcacctgaggtcagaagttcaagaccagcctggccagtatggtgaagccatgtctctactaaaaatacaaaattagccggacattgtggtgcacgtctgtcatcccagcaaggcaggcgaatcacttgaacccaggaagcagaggttgcagtgagccaggatcatgccattgcactccagcctggtcaacagagcgagactccgcctcattaaaaaaaaaaaaaaaaaaaaaaa

SEQ ID NO: 31 - DNA, 1796 bp, Homo sapiens
ggtcagctgagttcgccggcccagggcaggcggggcccgagcctagcggtaacccccgggcagggcggggccgctcgcagactccatatgagattcacctcgcaggtggttccctcattcgagtgctccggcgcacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggataggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaaatcccctgttgtgtggactttgagcacactttacacaagaatctagaaaatcagatcgcgattaagagacagagaatcttggattaaccgcatgggagatgttcttccttttgaagtttcattggagcattttcaatgatgttagcctgatttggggtttcttcaagaacattctaccaaatttttgtactatttctagggaaatttttcagactttaaaattctaatggtagtcagatttcatgtcactaaacaagaaatctgacaatagtgccaggaaactaatttcctgatacattaaaaaaattccatgcaaaaaaaaaaaaaaaaaaaa

SEQ ID NO: 32 - DNA, 2948 bp, Homo sapiens
aggtaatgattaatctgtcaggcacaaaagggattgttttggggatttcgggttctaagtcgcagattcaaacaaatagcagcgaacagggaatgacagttccaccagaagacgattaagccacagcctctaattggaacggcatttgtacagtcagagactcttaccagacatctccaggaatctgtgagccattgtcaaaacgtccattttcatctggctgtgaaagtgaggaccacaacaggtaggtattggtagaaacaggagtcctcagagaagccccaagatgcagcctgagggagcagaaaagggaaaaagcttcaagcagagactggtcttgaagagcagcttagcgaaagaaaccctctctgagttcttgggcacgttcatcttgattgtccttggatgtggctgtgttgcccaagctattctcagtcgaggacgttttggaggggtcatcactatcaatgttggattttcaatggcagttgcaatggccatttatgtggctggcggtgtctctggtggtcacatcaacccagctgtgtctttagcaatgtgtctctttggacggatgaaatggttcaaattgccattttatgtgggagcccagttcttgggagcctttgtgggggctgcaaccgtctttggcatttactatgatggacttatgtcctttgctggtggaaaactgctgatcgtgggagaaaatgcaacagcacacatttttgcaacatacccagctccgtatctatctctggcgaacgcatttgcagatcaagtggtggccaccatgatactcctcataatcgtctttgccatttttgactccagaaacttgggagcccccagaggcctagagcccattgccatcggcctcctgattattgtcattgcttcctccctgggactgaacagtggctgtgccatgaacccagctcgagacctgagtcccagacttttcactgccttggcaggctgggggtttgaagtcttcagagctggaaacaacttctggtggattcctgtagtgggccctttggttggtgctgtcattggaggcctcatctatgttcttgtcattgaaatccaccatccagagcctgactcagtctttaaggcagaacaatctgaggacaaaccagagaaatatgaactcagtgtcatcatgtagtggcatgctcagctctggatttgcagtcagtttgggattctcttcagaaagatggcatctaagtgtctgtgttcttgtaagcctgaggtggaatccacccagttttgtctgctagccatatgggacatctaattggaaaagcatctgcataaaagtttggaaacaatgaccacttctctaccattgtcccccaccccaccccccagaataacgctgactgtcccctgaaacagccttctctcctgccctgtttatttcatcctcgatgggaattcttgctaggtaagcactaataactcggcatcttgacgatagtcccatttgggtggtttcagctgcactatctgtatgaaatggtgtcaccaaaacccttttcttcagtatcgacaaagattacattctgagtaccaaccaaaccctaaattgaaagacaaaactatggtttcagtcaacatattcatgaattagggagctaatgggttaagcttccagttcccgctatgctactggatttgtataaatactgatattctccaaacctagtggtgtagggagcaagagaatgcagctggaaggcacaaggggaggacattgtggcattcagaaactgcaggagacaagatgaatttgagaagccaaatggaatttttaatggaaaccatttatcagattaatctcttgctctcctgcattttagaggacaccaattaatttcctggtctttagtatataataacctaaaataccattgtaacctcagtcatgaaaaatacatcactctgtctttttagctcaaatgtattttcctaattgcccacttgagaacagacatttgacaagttatatcaacgactgtgcttgtccattattttacacatgccctagaagccaaaactgaaagccactggatcctggtctagctgaatcttcagagtgggaggtctccaaaaagatattaccttattgggcttaacaattcacaaggcactttcacacccattatctaatttaatcctcataatgactatgtgaggcaaatgccacattgcccatttttcagataaagaaacaaaatcttagggaagataagttgagttgtccaagagcacactgaaagttgaatgttatctaatgcattcctctacctttcagaagatcagtagctggctgagaatctttgccaaatcttccttgctagccagaagtggaattggcagcttctagaatatgtacacctctggacaaaatgttcctcaatcttaagatacaaagaccctcattgtctgggtctattcccacacttactgagtacagatgaaggaaagtggtagcaatttaatcataactttcatttgctgaaaaacattatgagaaggcctcccttcctaagccacctctggtcttgctaagtcttgatcttgcttcctgccagcaccaaacattacattcaggggatttcctctggctcagtcttttccccttgaagttctctaatagatgttacttttgacaaaagatcgcctatgagttacaagcaccaggggatgctctacatcaagggatgcaccttcagtcaaactgtcaaaaagcccagaattcccaaaggcattaggtttcccaactgctttgtgctgatatcagaacagcagaaattaaatgtgaaatgtttctgatgacttatgttctacaatctatggacatacgggatttttttttcttgctttgaagctacctggatatttcctatttgaaataaaattgttcggtcattgtt

SEQ ID NO: 33 - DNA, 8546 bp, Homo sapiens
agattgcaaattcgcggtgactcagtctggtcggctccttgcgctcggcggccgcggcggcagcagcagcagacgctggcggccgggctgccaggagcagttccgccgggtttcactgtccgtgacttccttcggggcacctcaggcagcaaaccaagatggagtatgagtggaaacctgacgagcaagggcttcagcaaatcctgcagctgttgaaggagtcccagtccccagacaccaccatccagagaaccgtgcaacaaaaactggaacaacttaatcagtatccagactttaacaactacttgatttttgttcttacaaaattaaaatctgaagatgaacccacaagatcattgagtggtcttatcttgaagaataatgtgaaagcacactttcagaacttcccaaatggtgtaacagactttattaaaagtgaatgtttaaataatattggtgactcctctcctctgattagagccactgttggtattttgatcacaactatagcctccaagggagaattgcagaattggcctgacctcttaccaaaactctgtagcctgttggattctgaagattataatacctgtgagggagcatttggtgcccttcagaagatttgtgaagattctgctgagattttagacagtgatgttttagatcgtcctctcaacatcatgattcccaaatttttacagttcttcaagcatagtagtccaaaaataaggtctcacgctgttgcatgtgtcaatcagtttatcatcagtaggactcaagctctaatgttgcacattgattcttttattgagaatctctttgcattagctggtgatgaagaaccagaggtacggaaaaatgtgtgccgagcacttgtgatgttgctcgaagttcgaatggatcgcctgcttcctcacatgcataatatagttgagtacatgctacagaggactcaagatcaagatgaaaatgtggctttagaagcctgtgaattttggctaactttagctgaacagccaatatgcaaagatgtactcgtaaggcatcttcctaagttgattcctgtgttagtgaatggcatgaagtactcagacatagatattatcctacttaagggtgatgttgaagaagacgaaacgattcctgatagtgaacaggatatacggccacgttttcaccgatcgaggacggtggctcagcagcatgatgaagatggaattgaagaggaagatgatgatgatgatgaaattgatgatgatgatacaatttctgactggaatctaagaaaatgttctgctgctgccctggatgttcttgcaaatgtgtatcgtgatgaactgctgccacatattttgccccttttgaaagaattactttttcatcatgaatgggttgttaaagaatcaggcattttggttttaggagcaattgctgaaggttgcatgcagggcatgattccatacttgcctgagcttattcctcaccttattcagtgcctctctgataaaaaggctcttgtgcgttccataacatgctggactcttagccgctatgcacactgggtggtcagccagccgccagacacgtacctgaagccattaatgacagaattgctaaagcgcatcctggacagcaacaagagagtacaagaagctgcctgcagtgcctttgctaccctagaagaggaggcttgtacagaacttgttccttaccttgcttatatacttgataccctggtctttgcatttagtaaataccagcataagaacctgctcattctttacgatgccataggaacattagcagattcagtaggacatcatttaaacaaaccagaatatattcagatgctaatgcctccactgatccagaaatggaacatgttaaaggatgaagataaagatctcttccctttacttgagtgcctatcttcagttgccacagcactgcagtctggattccttccgtactgtgaacctgtgtatcagcgttgtgtaaacctagtacagaagactcttgcacaagccatgctaaacaatgctcaaccagatcaatatgaagctccagataaagattttatgatagtggctcttgatttactgagtggcctggctgaaggacttggaggcaacattgaacagctggtagcccgaagtaacatcctgacactaatgtatcagtgcatgcaggataaaatgccagaagttcgacagagttcttttgccctgttaggtgacctcacaaaagcttgctttcagcatgttaagccttgtatagctgatttcatgccaatattgggaaccaacctaaatccagaattcatttcagtctgcaacaatgccacatgggcaattggagaaatctccattcaaatgggtatagagatgcagccttatattcctatggtgttgcaccagcttgtagaaatcattaacagacccaacacaccaaagacgttgttagagaatacagcaataacaattggtcgtcttggttacgtttgtcctcaagaggtggcccccatgctacagcagtttataagaccctggtgcacctctctgagaaacataagagacaatgaggaaaaggattcagcattccgtggaatttgtaccatgatcagtgtgaatcccagtggcgtaatccaagattttatatttttttgtgatgccgttgcatcatggattaacccaaaagatgatctcagagacatgttctgtaagatccttcatggatttaaaaatcaagttggcgatgaaaattggaggcgtttctctgaccagtttcctcttcccttaaaagagcgtcttgcagctttttatggtgtttaatctaatacacttaagctgcagtcccaaaattaggggtccttcagtcttggagactataagggagcctctgcacccagggaaaatgttaccctttacaggggggaagggtaaaccagtagggaatacagtacaatcccaaccctactgggaggggcgggagggaggtgttgccgtcactgtattaagtcgatgttgggaaacgttttaacatctggagcctttgtgggtggaaatatgtctccagttacaactccgcagtggatgtgaagaagcaaaaaaaaaaaaatctattcagtctactcacaaaacagtacattgtggaatattatggggaattgtaccaaaacaagaaccatataaatgatgcctagggacaagaaagaggaacaattctatagcgcacaataaaggaaacctaagaatgggagttacaaatagtaaagaagctttttttttttttttaatttaaagtttttttatgtaagttttcccacatgatggggccttgttttgcatgttgatgaagaactacacaaagaaaactaatatagttaaaagtcagcttgccttcccgtagtagaagcaggttcttggaagttacaatttaaggtaccccaaaaaagttggaaataaaacaaaacaaacataaacaatgaagcaccctgtgaaatgccaaatgagtcactccttttaccttttttggggtgggcagggagggaggaataaatggggttgggcatatcaaactaaagatgacatcttaattttgcattgaacattaatgtagcggatataatttgatgattatacttcattagatttaatttctaggccaagatgttactttttaaagtgcagtttaaggttcaggcatgcattctggctcatagtggttgaaagtaatttaaattagtgggaaagtagcatgcttgcatcacatagagtgagattggtattcatttacctatgttgcgccagtttgtgttgcagtttaccaattcaatatagccctgcatttaaagttcctttttaagatttgtggattttatttttattaagaacatagatatataaagtactgtagtttacaggtaggccttgaaatatcttttttaggatctgttaggaataagattgatattgtattgtgtgtaacctgcacaatgtggaaagctgatatacctgtgcaaaatctttgcctctgtgctgtcagtgtgatgtgctttctgcatggttatatactactagtgattttatcaaaacttctaaaatttaaattacgtggtaaaagatctgtaaaaggctgcataaatgttagttggcacataaagacaattgtagaagttgaaaaatgattgctatatttcaatgtttattcccactcaacatactgccttctaagcttccctttttttgttcaaagcatgatcttaaagatatgtttaagttaatggatgtaatgcagggttcctacactgtattttggcgcatgttggtggccctctgtgccctagatatatgcacacagggtgcaagttaaaagctacagagtgaaagttggtttggatcctcttcatttcatttgtttagcttttctgttatttttctctacttacatgtattcctgtgaataaatccttgttaagttaaccctttacttttccttccatgtgtattttcttatatactgtgaatgtgaaaacctaactggtacacttgatcttgtgttcatatgaaagtgcaagtctttattaatttggattgcctgaacagtgtatcccatgatgatgaaggaaaatggagagatttttctttttaactctgctggtcagagatgaagccacgcctttccatttttcaatgctgcatatttaatctgcaacaaaaatgttaagccataacagcctttttatattttagtttgtcacctttgcattgcagaataaatactgaataaccatttttataagcagttgctcctctttgcatggttctattctctaaaagtgttgaatgatacagccattgcactgaagtttgagctgtgtgcgtgtgaatttatactgtttcaaaaatttcaaatgcatggtagcatgtagaaaggtttttgttactatgtgtgtgtgtgtgttttgttttgttttgttctgttttttaacgttctttcacctttcctctactttggctttgcaaatttcagtctgtagagcctgaaattaaattattttatagtgcctgatatttttaatattataagttggattcaaagggtatacagcattttgttttctagtaccattgcttcactgggagctcaaaatttgcctccctgttagtctttaataactgagtagagtagcttttttattcttagattatagtgatattctgtagtgcttcaaatacttagaattctaatatgagagatagtttaatattctggaatagagagtattttaaattgaaatgaccaaattcgatttaaaacaaacacataacaatcttcagtaaagttatttgaacctgtggttgacaattctgtattgactaaaggcaatattgtcacctgtctcattaaaaattagtttccagttaggcagatgaataacactattaaaaatgcacccagttttgtagtcacttgactttttttttttatttaaatgaaatttaatttgaaaatagaaaataaaattaggtaaatatgactggcaacctgaatttgagttgggattctttgtgtatttttcccccttgaggttattgtttcttcctaatttatatttcagatacatagtgtagaacaggaatttgcagaagccatttaagttatcttttgaggtaagctctgatttagcatttattctgataaaatctaatacatcatgggatatatataaagcaacttaattcttgtggtgtagtcttaatagttttgaatgttgactgaatgtctataaaattgtgagtttgtctttgttacattccagtgtttctgcctcttggcatgcttaaagcacggcttacttcatctgctccttacacactaaaatgctgttagtgtgctcaactacagaaatagccgctgctaagtgatgtagattttctacttgaatatttttatgttgtaggaacctcaggaggtcagtgtttactgttttatatatgccttctttttcctgtttgagcttctctctttgaaggattctaacagaacaaagctgctgatcaacctaagttggaaacagaaagtgtaattaatataacttaaatgcatgtttggcagttccatgttacagtccattagcgagtgaacttagtgccacaggtattcatttattcaggaaagaattttgctttttgtattgtctaatctcttcaatgacttcatactgtgtaaaaaaaaatcactttttaatattttttggttggttatttcccaaataatcaacatgtaaataatcttttaagagccagttctgatgctttacattattgctacttgattttgttatgcaagttagatttcagaagaatagattttaaaacacttaaccaagccattacatcttaaaaacaaaacaagtagcatacattttgtaattaacattgataaacactgtgatttttttggttaagactttttcattgatctgaattgcttaaattgcatatattgtaaaataggatcagatgtatattttaaactaatttcaatggattttcctcttgaaatgctttgtctactcagttataaaatattcagatacaagttttatctcaggtgaatactcttgtattgtttttgctttggtgacatgcttataaagggtcatcctagttacattctttgttttttaagtgtatttcattgagaatctttccatttagtctgatttttttcctaatattctagcaggctggggtggtataaagccctcctgacaagccttttgcctacaggtttacctgaaaatgagctacatatggtcgtcattttcttcaaactctcaaaataggaaagtggaaatttttctcccctatataaaattattctgcctagcagaaatgccagaaataaattaattgcatcttagtctaaatttaagtcctttgccatgaggaaaaagtggttttttgcttcatatggtaaatctatattattcatattgaatgtattaacagataatggtgcaaaagcattcttcccaggggaagagtgtatcatgcataactgcaatttaagtccttcctttgataatacttcaaaacatacacagctttgcttactgaattatttttgcaaataatacaaggaggggaaactaacttgctactagtgttgttaatgaagtataggccttggaacatttaagaaaactggtcttcagatagttaagggcttgggataatttaagtgaaaagtgagatcagtaatgagctgtgttgttaacaatattatctggtaataataccatgcaatatagcgttgtataccaacttagtgcattttatactgtattaaatatggagatacttctaatgcctctctaaaattaaattttacataaaagttagttttattcacctttaggctttccaagtgaattgtgactaattttttcaatcttacatagatctttcacccattagcattacttacgtagataattctttatgcctagttattatacatattaatttttaaggtatacatttaaattacacaattgttcattgtggtttgtatcccagaatgtgttgtgttttttaaaagatgcataatagctgaatgtatgcatgactttgaaagaagttaaaatggtgattttttttcacctcttgtacattttaaaaccaggccaaatctatttgccaagcagtgtatcactaataagaaaagcagtttttccttttattgcagtttttgtttatctgccatagaatttccttatactgtggcttggtattattcaagattagctatttcgctggtattacatctttttaaaagcctattataacatggttagcctataaggcagtgttggtccccttctaatattggcctcataaaggggttccactgtactttccgcatattactgtgttgttgttttcctttgtggatatataagcaaattgagcttgggtgatttttatggagacaataattagacaatactgtataattagttttacttaatagattatcatcttgtgagaagagatgtttaaacgtggtaaatcacttcatattacaaaacagttttacacttaatatgttaacattgggtgcaataatttagtagcattagctttagttacaaatataactggatctttctgctgacaacttaggttgtatgagttatgcttaaaagctttaaatctgatgtttcctgtacctgccacactatgttagaatgtgtccttcaaacatatcctcctgcaacttctcaaactgtactaaattgatatttcttgaagtctaactctgtgctaacagatctccattttaaatagaatacggttttaatttttgataagctgctgaattttaaagagagttttttggggccaccaaatattttggatcatgcagagaatatatattgtactgtagtaattttgtatttacatttgtatgatgtgacataatagatgtgaatgttaatcactgcttgactatgttaataaagttgtttaactata

SEQ ID NO: 34 - DNA, 3085 bp, Homo sapiens
gacggccgccggagccgcgaggccaactgtcgcctggttgggcccggaaatgggacgtcgcgctttctcagggagcgtagaagcagccagggcctctccaagccgctgctgtgacagaaagtgagtgagctgccggaggatgtccaccgccacgacagtcgcccccgcggggatcccggcgaccccgggccctgtgaacccaccccccccggaggtctccaaccccagcaagcccggccgcaagaccaaccagctgcagtacatgcagaatgtggtggtgaagacgctctggaaacaccagttcgcctggcccttctaccagcccgtggacgcaatcaaattgaacctgccggattatcataaaataattaaaaacccaatggatatggggactattaagaagagactagaaaataattattattggagtgcaagcgaatgtatgcaggacttcaacaccatgtttacaaattgttacatttataacaagcccacagatgacatagtgctaatggcccaagctttagagaaaatttttctacaaaaagtggcccagatgccccaagaggaagttgaattattaccccctgctccaaagggcaaaggtcggaagccggctgcgggagcccagagcgcaggtacacagcaagtggcggccgtgtcctctgtctccccagcgaccccctttcagagcgtgccccccaccgtctcccagacgcccgtcatcgctgccacccctgtaccaaccatcactgcaaacgtcacgtcggtcccagtccccccagctgccgccccacctcctcctgccacacccatcgtccccgtggtccctcctacgccgcctgtcgtcaagaaaaagggcgtgaagcggaaagcagacacaaccactcccacgacgtcggccatcactgccagccggagtgagtcgcccccgccgttgtcagaccccaagcaggccaaagtggtggcccggcgggagagtggtggccgccccatcaagcctcccaagaaggacctggaggacggcgaggtgccccagcacgcaggcaagaagggcaagctgtcggagcacctgcgctactgcgacagcatcctcagggagatgctatccaagaagcacgcggcctacgcctggcccttctacaagccagtggatgccgaggccctggagctgcacgactaccacgacatcatcaagcacccgatggacctcagcaccgtgaaaaggaagatggatggccgagagtacccagacgcacagggctttgctgctgatgtccggctgatgttctcgaattgctacaaatacaatcccccagaccacgaggttgtggccatggcccggaagctccaggacgtgtttgagatgaggtttgccaagatgccagatgagcccgtggaggcaccggcgctgcctgcccccgcggcccccatggtgagcaagggcgctgagagcagccgtagcagtgaggagagctcttcggactcaggcagctcggactcggaggaggagcgggccaccaggctggcggagctgcaggagcagctgaaggccgtgcacgagcagctggccgccctgtctcaggccccagtaaacaaaccaaagaagaagaaggagaagaaggagaaggagaagaagaagaaggacaaggagaaggagaaggagaagcacaaagtgaaggccgaggaagagaagaaggccaaggtggctccgcctgccaagcaggctcagcagaagaaggctcctgccaagaaggccaacagcacgaccacggccggcagacagctgaagaaaggcggcaagcaggcatctgcctcctacgactcagaggaagaggaggagggcctgcccatgagctacgatgaaaagcgccagcttagcctggacatcaaccggctgcccggggagaagctgggccgggtagtgcacatcatccaatctcgggagccctcgctcagggactccaaccccgacgagatagaaattgactttgagactctgaaacccaccactttgcgggaactggagagatatgtcaagtcttgtttacagaaaaagcaaaggaaaccgttctcagcaagcgggaagaaacaggcagccaagtcgaaagaggagctagctcaggaaaagaagaaggagctggaaaagcgtctgcaggatgtcagcgggcagctgagcagcagcaagaagcccgcccggaaagagaagcccggctcagcaccctcagggggcccgtccaggctcagcagcagcagctcctccgagtctgggagcagcagctccagcgggtccagctctgacagcagtgactcagaatgaactggcttcggacagaacaggacagatggatgtcgcacacgccgagactctgccgtacccctctgtggttcatattactacttctgttccatggtgtgcaggtctgcttcttaattcagtgttatgatatcttccagtttttgctttcataggtcagagatctatcttgtgtgtgcgttagacttgatgagaaggtgtgaactctgcagaaagtctcttcttcatcactgaattcagtcacttggagatgacaacttcaaatgctaacccgatgaccccagaaaaccgtgtgagattcgtaccgaagaaccttgtggaatccctttgcttaggcccaacctggtcgatagctcgagaaagaattttttccaaggaaatgtctcggatatgggtactgtatttgaaagctgttagctttgtcaacacgcattgtccttgtcatttgggccccgagctctgaccctcgtgtctgacgcggccacctctttctggaggggctgaggacagatgtgcctgcttgtggagaccaggctgggcctaagcgaagggtcatcgcagccccagcccggagcgtggagcccttggggggtggtcgggtgggatgtgcgttctccgctcgtggtgatgtcaggagctcctcggagggaacagagcggctgtgtatgcagcctgcaggtttccatacactgaagcttttacctcaactttaaaaaaaaaaaagaagaaaagattaaaaaaaaaaaaaaaaaactcgaggcatctatg

SEQ ID NO: 35 - DNA, 3915 bp, Homo sapiens
gtggggtggggtggggctgggggcttgtcgccctttcaggctccaccctttgcggagattataaatagtcatgatcccagcgagacccagagatgcctgtaatggtgagactttggatccttcctgaggacgtggagaaaactttctgctgagaaggacattttgaaggttttgttggctgaaaaagctgtttctggaatcacccctagatctttcttgaagacttgaattagattacagcgatggggacacagaaggtcaccccagctctgatatttgccatcacagttgctacaatcggctctttccaatttggctacaacactggggtcatcaatgctcctgagaagatcataaaggaatttatcaataaaactttgacggacaagggaaatgccccaccctctgaggtgctgctcacgtctctctggtccttgtctgtggccatattttccgtcgggggtatgatcggctccttttccgtcggactcttcgtcaaccgctttggcaggcgcaattcaatgctgattgtcaacctgttggctgtcactggtggctgctttatgggactgtgtaaagtagctaagtcggttgaaatgctgatcctgggtcgcttggttattggcctcttctgcggactctgcacaggttttgtgcccatgtacattggagagatctcgcctactgccctgcggggtgcctttggcactctcaaccagctgggcatcgttgttggaattctggtggcccagatctttggtctggaattcatccttgggtctgaagagctatggccgctgctactgggttttaccatccttcctgctatcctacaaagtgcagcccttccattttgccctgaaagtcccagatttttgctcattaacagaaaagaagaggagaatgctaagcagatcctccagcggttgtggggcacccaggatgtatcccaagacatccaggagatgaaagatgagagtgcaaggatgtcacaagaaaagcaagtcaccgtgctagagctctttagagtgtccagctaccgacagcccatcatcatttccattgtgctccagctctctcagcagctctctgggatcaatgctgtgttctattactcaacaggaatcttcaaggatgcaggtgttcaagagcccatctatgccaccatcggcgcgggtgtggttaatactatcttcactgtagtttctctatttctggtggaaagggcaggaagaaggactctgcatatgataggccttggagggatggctttttgttccacgctcatgactgtttctttgttattaaaggataactataatgggatgagctttgtctgtattggggctatcttggtctttgtagccttctttgaaattggaccaggccccattccctggtttattgtggccgaactcttcagccagggcccccgcccagctgcgatggcagtggccggctgctccaactggacctccaacttcctagtcggattgctcttcccctccgctgctcactatttaggagcctacgtttttattatcttcaccggcttcctcattaccttcttggcttttaccttcttcaaagtccctgagacccgtggcaggacttttgaggatatcacacgggcctttgaagggcaggcacacggtgcagatagatctggaaaggacggcgtcatggagatgaacagcatcgagcctgctaaggagaccaccaccaatgtctaagtcgtgcctccttccacctccctcccggcatgggaaagccacctctccctcaacaagggagagacctcatcaggatgaacccaggacgcttctgaatgctgctacttaattcctttctcatcccacgcactccatgagcaccccaaggctgcggtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactaggggatataggagaggaaaagtaaggtgcagttcccccaacctcagacttaccaggaagcagatacatatgagtgtggaagccggagggtgtttatgtaagagcaccttcctcacttccatacagctctacgtggcaaattaacttgagttttatttattttatcctctggtttaattacataatttttttttttttactttaagtttcaggatacatgtgccgaatgtgcaggtttgttacataggtatatatatgccatgatggaaatatttatttttttaagcgtaattttgccaaataataaaaacagaaggaaattgagattagagggaggtgtttaaagagaggttatagagtagaagatttgatgctggagaggttaaggtgcaataagaatttagggagaaatgttgttcattattggagggtaaatgatgtggtgcctgaggtctgtacgttacctcttaacaatttctgtccttcagatggaaactctttaacttctcgtaaaagtcatatacctatataataaagctactgatttccttggagcttttttctttaagataatagtttacatgtagtagtacttgaaatctaggattattaactaatatgggcattgtagttaatgatggttgatgggttctaattttggatggagtccagggaagagaaagtgatttctagaaagcctgttcccctcactggatgaaataactccttcttgtagtagtctcattacttttgaagtaatcccgccacctatctcgtgggagagccatccaaataagaaacctaaaataattggttcttggtagagattcattatttttccactttgttctttaggagattttaggtgttgattttctgttgtattttaactcatacctttaaaggaattccccaaagaatgtttatagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgtagcccacacttgagaggatgaatgtatgtgcactgtcactttgctctgggtggaagtacgttattgttgacttattttctctgtgtttgttcctacagcccctttttcatatgttgctcagtctccctttcccttcttggtgcttacacatctcagaccctttagccaaacccttgtcagtgacagtattttggttcttagttctcactgttccctctgctcctggagcctttgaataaaaatgcacgtagctgaggccggatgcggtggctcacgcctgtaatcccagcactttgggaggcctaggcgggcggtcaggggttcgagaccagtctggccaacatcgtgaaaccctgtctctactaaaaatgcaaaaattagccgggcgtggtggcgggcgcctgtaatcccagctacttgggaagctgaggcgggagaatcatgtgaacccgggacgcaggggttgcagtgagcggagatcgcatcattgcactctagcctgggccacagggcgagactccgtctcaaaaaaaaaaaaatgcacatagctatcgagtgtgctttagcttgaaaaggtgaccttgcaacttcatgtcaactttctggctcctcaaacagtaggttggcagtaaggcagggtcccatttctcactgagaagattgtgaatatttccatatggattttctattgttactctggttctttgttttaaaataaaaattctgaatgtacacg

SEQ ID NO: 36 - DNA, 2109 bp, Homo sapiens
ttgctgcatagattacaacggtgatggcgggcaagcggtccggctggagccgggcggctctcctccagctccttctcggcgtgaacctggtggtgatgccgcccacccgggcccggagtctgcgcttcgttaccttgctgtaccgccatggagaccgttcaccagtgaagacatatcccaaggacccctatcaggaagaagaatggccccaggggtttggtcagttaaccaaggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacaggctgctgaagttcccgttgggcccatgtccccgttatgagcagctgcagaacgagacccggcagacaccagagtatcagaatgagagttctcggaatgcacaatttctggacatggtggccaacgagacagggcttacagacctgacactggagaccgtctggaatgtctatgacacactcttctgtgagcaaacgcacgggctgcgcctgccgccctgggcctcaccccaaaccatgcagcgtctcagccggctaaaggacttcagcttccgcttcctcttcggaatctaccagcaggcggagaaggcccggcttcaggggggagtcctgctggctcagataaggaagaacctgaccctaatggcgaccacctcccagctccccaagctgctggtttactctgcgcacgacactaccctggttgccctgcaaatggcactggatgtctacaatggtgaacaagccccctacgcctcctgccacatatttgaactgtaccaggaagattctgggaatttctcagtggagatgtactttcggaacgagagtgacaaggccccctggccgctcagcctgcctggctgccctcaccgctgcccactgcaggacttccttcgcctcacagagcccgtcgtgcccaaggattggcagcaggagtgccagctggcaagcggtcctgcagacacagaggtgattgtggccttggctgtatgtggctccatcctcttcctcctcatagtgctgctcctcaccgtcctcttccggatgcaggcccagcctcctggctaccgccacgtcgcagatggggaggaccacgcctgacaaccactcagcccccttccctccacctcctaggggaggtgggctgggccctcgctcctgactgttgctgctccccagcccatggacaggagatcctgggttgggcctccctctgatgaccccagccagatgagcgagtggggctcagcgtggcccatggtgcctgtcactcagcattcccatgcctgatgtttaccaagtgctgtgttggacactggctttctccaaacaggatttgcctcctccacgctccctacacacctgagatgtaaactggcagtcagtgttcactcaggacctaggattagaaaatggcagagttggtgctggatccaccttgcacttctatcaagccctgttctttttcctccagcctgaagtcttcggcaaatagctcagagggacacggtcttgcctctcagtgcttattttagtgggaaaaacagctaataccaggggtacaaacattggctcccaaggaactggatcacccaacagccagccagccacatttccctgtgtctggctagagccaccattagactcagacagaatgcttcaggaatcgttgtcaccccttcaactggagcaggacggaaggttgtctgtacttgggagggagtggggagtggtgggaagggagttgcttgtcacacgaatcaggaaactgctctccctcagctgggctggggtctccagggacctgagctacatgcaggttgtgagctggaaaagaaagttctagactgtggcccagaatagggctggggcagctcccagagaatgaatagtgctgtttcctattggactgata

SEQ ID NO: 37 - DNA, 2375 bp, Homo sapiens
gggcgcggagccccagccgagcctagccctgcccggccccggaggacttgcaacactccgaggccaggaacgctccgtctggaacggcgcaggtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcggtgagtgatagcttcgggcctggagagtgggatgaccggaaagtgcgacacacttttatccgaaaggtttactccatcatctccgtgcagctgctcatcactgtggccatcattgctatcttcacctttgtggaacctgtcagcgcctttgtgaggagaaatgtggctgtctactacgtgtcctatgctgtcttcgttgtcacctacctgatccttgcctgctgccagggacccagacgccgtttcccatggaacatcattctgctgaccctttttacttttgccatgggcttcatgacgggcaccatttccagtatgtaccaaaccaaagccgtcatcattgcaatgatcatcactgcggtggtatccatttcagtcaccatcttctgctttcagaccaaggtggacttcacctcgtgcacaggcctcttctgtgtcctgggaattgtgctcctggtgactgggattgtcactagcattgtgctctacttccaatacgtttactggctccacatgctctatgctgctctgggggccatttgtttcaccctgttcctggcttacgacacacagctggtcctggggaaccggaagcacaccatcagccccgaggactacatcactggcgccctgcagatttacacagacatcatctacatcttcacctttgtgctgcagctgatgggggatcgcaattaaggagcaagcccccattttcacccgatcctgggctctcccttccaagctagagggctgggccctatgactgtggtctgggctttaggcccctttccttccccttgagtaacatgcccagtttcctttctgtcctggagacaggtggcctctctggctatggatgtgtgggtacttggtggggacggaggagctagggactaactgttgctcttggtgggcttggcagggactaggctgaagatgtgtcttctccccgccacctactgtatgacaccacattcttcctaacagctggggttgtgaggaatatgaaaagagcctattcgatagctagaagggaatatgaaaggtagaagtgacttcaaggtcacgaggttcccctcccacctctgtcacaggcttcttgactacgtagttggagctatttcttcccccagcaaagccagagagctttgtccccggcctcctggacacataggccattatcctgtattcctttggcttggcatcttttagctcaggaaggtagaagagatctgtgcccatgggtctccttgcttcaatcccttcttgtttcagtgacatatgtattgtttatctgggttagggatgggggacagataatagaacgagcaaagtaacctatacaggccagcatggaacagcatctcccctgggcttgctcctggcttgtgacgctataagacagagcaggccacatgtggccatctgctccccattcttgaaagctgctggggcctccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaagtttatgtctagaagttaaaacccaaaaaaaaaaaaaaaaaaaaaaaaaa

SEQ ID NO: 38 - DNA, 2158 bp, Homo sapiens
ccgaggccagagagaaaagactgcgaggtggccgcagctgtggccggagagcacaaagaatgaaccagcagtggaagagaaaatactgtaagctggctgactgctggtgaagaaaatgctttatttttgtggcaggcatctgtgggatctgtaatagaaatatattggagtaattcaagattctgtggttggcccttttgactgctctctctacaggtttaatttgggcatttactcattttcatggctccaaggaccatgtatgtgttggggatcttcaatattcatgttattttctcctttggtcttatatgattgttacctttatgaagctttagtgattacaaagcactttttttgtccatttttacctgagctttgtaaactctgatttgcaggatggctggctgtggtgaaattgatcattcaataaacatgcttcctacaaacaggaaagcgaacgagtcctgttctaatactgcaccttctttaaccgtccctgaatgtgccatttgtctgcaaacatgtgttcatccagtcagtctgccctgtaagcacgttttctgctatctatgtgtaaaaggagcttcatggcttggaaagcggtgtgctctttgtcgacaagaaattcccgaggatttccttgacaagccaaccttgttgtcaccagaagaactcaaggcagcaagtagaggaaatggtgaatatgcatggtattatgaaggaagaaatgggtggtggcagtacgatgagcgcactagtagagagctggaagatgctttttccaaaggtaaaaagaacactgaaatgttaattgctggctttctgtatgtcgctgatcttgaaaacatggttcaatataggagaaatgaacatggacgtcgcaggaagattaagcgagatataatagatataccaaagaagggagtagctggacttaggctagactgtgatgctaataccgtaaacctagcaagagagagctctgctgacggagcggacagtgtatcagcacagagtggagcttctgttcagcccctagtgtcttctgtaaggcccctaacatcagtagatggtcagttaacaagccctgcaacaccatcccctgatgcaagcacttctctggaagactcttttgctcatttacaactcagtggagacaacacagctgaaaggagtcataggggagaaggagaagaagatcatgaatcaccatcttcaggcagggtaccagcaccagacacctccattgaagaaactgaatcagatgccagtagtgatagtgaggatgtatctgcagttgttgcacagcactccttgacccaacagagacttttggtttctaatgcaaaccagacagtacccgatcgatcagatcgatcgggaactgatcgatcagtagcagggggtggaacagtgagtgtcagtgtcagatctagaaggcctgatggacagtgcacagtaactgaagtttaaataaaaatgtcttcagctccatgctcaaggttgaaagggttacctgtaaatttctgcccacataacattatactcatccctagtagtgcattttgggagttggggtgggaaggggtatgggaaggatagactcataattaaaatgtctaacatgtctctgttgagaaatttatttaatgtaaggaacttgggtgttaatagttgagagctgtttagtaataacccagttttcttgaggtctgtttactttatactttttaaaaacttctgtagttcttttggccagtgtgtttgtattatctgtgcattaatggtcctcatctgactcctgcattgtgtcttatttttctgcatggattggcataagaccattactaaaatttggcacctgtgagatgtttgatattatgaacaggaaacataatttaatgtatgaatagatgtgaatttgggatttcaaaatagatgaataacaactattttatagtaaagttattgaaatggaaatgaaaacagccagtaacttatgtttcagaatgtttgtaacacacttcatggtgttcccataggctttgctgtctagtcttatagtttgaggtttttttggtctgcatttttctttttgattacaaaatttataatttaataaatactagagtttatcaaaaaaaaaaaaaaaaag

SEQ ID NO: 39 - DNA, 7525 bp, Homo sapiens
ggtgctggagagacagggagaggggcgaaccggccccccacagccactgcaggagttccaccatcttcctctgaagacgtagccatcttgctccatgaagggtgaatcgaaacgcatcaccctggtcctccagcagccacagtctggaggtccccaaggacatcggcatgttgtgctagggagtctaccaggcaagatagtgttacagggcaaccagctggcagccctgactcaagccaagaatgcccaagggcagcctgccaaggtagtaactatccagctgcaggtgcagcagccacagcaaaaaatccagattgtaccacaaccaccatcatcgcagccacagccccagcagccaccctccacccagccagtgactctgtcctctgtacagcaggctcagataatgggaccaggacaaagcccaggacaaagactttcagtaccagtcaaggtggtactgcagccacaggctggctcttcccaaggggcctcttctgggctctctgtagttaaagttctgagtgccagtgaagtggcagctttgtcatcaccagcaagctctgctcctcattcggggggaaagacaggaatggaggaaaaccgcagattggaacaccagaagaagcaagagaaagcaaatcggattgtagcagaggccattgcgagagcccgtgcccgcggtgagcagaacatacctcgagtcttaaatgaggacgagttgcccagcgttcggccagaggaggaaggcgagaagaaacgcaggaagaagagtgctggggagaggctgaaagaggagaagccaaagaagagtaaaacatctggtgcctccaaaacaaagggcaagagcaagctcaacaccatcactcctgtagtgggtaagaagagaaaacgtaatacctcatctgataattcagatgtggaagtcatgcctgcacagtcacctcgagaagatgaagaaagcagcattcagaagagacgctcaaaccgccaagttaagcgaaaaaaatatacagaggacctggatataaagatcacagatgatgaagaagaagaagaggtggatgtaactggtccaataaaacctgagcctatcctccctgaaccagtgcaagaaccagatggcgagactttgccttccatgcagttctttgtggagaatcccagtgaagaagatgcagccattgtagacaaagtgctttctatgcggattgtgaagaaggagctcccttctggacaatatactgaagcagaagaattctttgtcaagtacaagaactactcctatctgcattgtgaatgggctactatctcccaactagagaaggataagaggatacatcaaaaattaaagcgcttcaaaaccaaaatggctcagatgagacacttcttccatgaggatgaagagccctttaatccagactacgtagaggtggataggatattggatgagtctcacagtattgacaaggacaatggggagcccgttatttactacctggtgaaatggtgctctctgccctatgaggatagcacatgggagctaaaagaagatgttgatgagggcaagattcgagaatttaaacggattcagtcaaggcacccagaactcaaaagggtgaatcgtccgcaggcaagtgcctggaagaaattggagctatcacatgaatataaaaacagaaaccagctacgggaatatcagttggaaggggttaattggctgctctttaattggtataacaggcagaactgcatcctggctgatgagatgggattgggcaaaactattcagtccattgccttcttgcaggaagtatataatgtgggcatccatggtcccttcttggtcattgccccactgtccacaattactaactgggagcgagaatttaatacatggacagaaatgaacactattgtgtaccatggcagtctggccagcaggcagatgattcaacagtatgaaatgtactgcaaagattcacggggacgcctcatcccaggcgcatacaagtttgacgctctgatcaccacttttgagatgattttgtcagattgtcctgagcttcgtgaaattgaatggcgttgtgttatcattgatgaagcccatcgactgaaaaaccgtaattgcaagctgcttgatagtctcaagcacatggacctggaacacaaggtgctactcacaggaacaccattgcaaaatactgtagaagaactgtttagcttgcttcatttcttggaaccgtcacaatttccctcagaatcagagtttctcaaggactttggggatctcaagacagaggaacaggttcaaaagctacaggccattcttaagccaatgatgctgagaagactcaaagaggatgttgaaaaaaacttggcacccaaacaggaaacaattattgaagtagagctgactaatatccagaagaaatactatcgggctattttggagaagaatttctccttcctttccaaaggggcaggtcataccaacatgcctaatctacttaacacaatgatggagttgcgcaagtgctgcaaccacccatatctcatcaatggtgctgaagaaaaaatcctaacagaattccgtgaagcttgccatattatacctcatgactttcacctgcaggccatggttcgttcagccggcaaactggttcttattgacaagttgcttccaaagcttaaagctggtggccataaagttctgatcttctctcagatggtgcgctgcctagacatcctagaggattatttaatccagaggaggtacttatatgaacgtattgatgggcgagttagaggcaaccttcgacaggctgccattgaccgcttcagcaagcctgactcagaccgctttgtcttcttactgtgtacccgggctggtggacttggtattaatcttacagctgctgatacctgcatcatctttgattcagactggaatccacaaaatgacctgcaggcccaggcacgatgtcatcgaattgggcagagcaaagctgtgaaggtgtaccgcctcatcactcgtaattcctacgagagagagatgtttgataaggccagcctcaagttggggttggataaggctgtgcttcaatccatgagtggtcgggatggcaacattactggaatccaacagttctctaagaaggagattgaagatcttttaagaaaaggagcatatgcagccatcatggaggaagatgatgaaggctccaagttttgtgaagaggacattgaccagatcttgttaagacgaactacaaccatcaccattgaatctgaaggaaaaggttccacctttgctaaggcaagctttgttgcttctgaaaacaggacagatatttctttggatgaccccaacttttggcaaaagtgggccaaaaaggctgacctagacatggatctgctcaacagcaagaataatttggtaattgacacacctagagtacgaaaacaaacgcgccactttagcactctgaaagatgatgacctggtggaattctctgatttggaaagtgaggatgatgagcggccacgctcccgcagacatgaccgtcatcatgcctatgggcgcactgactgctttcgggtggaaaagcatctcctggtatatggttggggacgatggcgagatattttatctcatggacgcttcaagcgacgtatgactgaacgagatgtggagaccatttgtcgggccattctcgtgtactgtcttctacactaccgtggggatgaaaatattaaaggcttcatctgggacttgattagcccagctgaaaatggcaagacaaaagaattgcagaatcattcaggtctatctatccctgtgcctcgtggacgcaaaggaaaaaaagtaaagtcacaaagcacttttgatatccataaggcagattggatccggaaatataaccctgacactttgttccaagatgaaagttataagaagcacttgaaacatcagtgtaacaaggtactgttgcgggtacgaatgctatactacctgaggcaggaggttattggagaccaagcagaaaaggtgttagggggtgcgattgccagtgagattgacatatggttcccagtagtggatcaactggaggttccaacaacttggtgggacagtgaggctgacaagtcgctgctcattggagtctttaaacatggctatgagaaatataataccatgagggcagacccagccttatgtttcctagaaaaggctggccgaccagatgacaaagcaattgcagcagaacatcgagtgttggataacttctctgacatagtagaaggggttgactttgataaagattgtgaagatcctgaatataaaccactccaaggtcccccaaaggaccaagatgatgagggtgatcccttgatgatgatggatgaggagatctcagtgattgatggagatgaagcccaggtgacccaacagccaggccatttattctggcctccgggctctgccctaacagctaggcttcggcgtctagtaacagcgtatcagcgcagctacaagagagaacaaatgaagatagaggctgcagaacgtggggaccggcgaaggcggcgttgtgaagcagccttcaagctgaaagaaattgcacggcgggagaaacaacaacgatggacaaggcgtgaacaaactgatttttatcgagtggtgtctacgtttggtgtggaatatgaccctgacaccatgcagttccattgggatcgcttccgcacttttgctcgactagacaaaaagacagatgaaagccttaccaagtacttccatggctttgtggccatgtgccgccaagtatgccgccttcccccagcagctggagatgaaccccccgaccctaacctgttcattgagcccatcactgaggagagagcctcacggactctctaccgtatagaattgcttcggcgcttacgggaacaagttttatgccacccccttttggaagatcggctggcattgtgtcagcctcctggtcctgaattgcccaaatggtgggagcctgttcggcatgatggggagcttctaagaggggcagcccgccatggggtgagccaaacagactgcaacatcatgcaggacccagacttctcttttctggctgcccgtatgaattatatgcagaaccatcaagcaggagcaccagctccatccttgtcacgctgctctactccactgctgcaccagcagtatacctcacgcactgcctcaccactgcccctgcgcccagatgctcctgttgaaaagtcacccgaggagacagctacccaggtccccagtctggagagtctgactttaaagctagagcacgaggtggtggccaggagccgaccaaccccacaagactatgagatgcgagtatccccctctgatactacccctctggtttcccggagtgttccaccagtcaaactggaggatgaggatgattcggactctgagctggacttgagcaagctgtcaccatcttcttcttcttcctcatcctcatccagctccagctccagcactgatgagagtgaggatgagaaggaagagaagctaactgaccagtcccgctcaaagctctatgatgaagagagtctcctgtccctcactatgtcccaagatggattcccaaatgaagatggagaacaaatgacccctgagcttctgctactgcaggaaagacaaagagcctctgagtggcccaaggatcgtgtcctgataaaccgtattgacctcgtctgccaggctgtactctcagggaagtggccttctagccgtaggagccaggaaatggtaacaggaggaattttggggccaggcaaccacttgctagacagtccctcattgactcctggagaatatggtgactctccagtccccacaccacgaagtagtagtgcagcttccatggcagaggaggaagcatctgcagtcagcacagcggcagcccagttcaccaaacttcgccgaggcatggatgaaaaggagtttacagttcaaatcaaagatgaggaaggattgaagttaacattccagaagcacaagttgatggcgaatggagtaatgggagatggacatccactgtttcataagaagaaggggaacagaaagaagctagtagagctggaggtggagtgcatggaagagcctaatcaccttgatgtggacctggagacccggatccctgtcatcaataaggtggatggtactttgctggtgggtgaggatgcccctcgccgggctgaactggagatgtggttacagggtcatccagagtttgctgttgatccccgatttctagcgtatatggaggatcgcagaaaacagaagtggcaaagatgtaaaaaaaataataaggcagaattgaactgtttgggaatggaaccagtacagacagctaactctagaaatgggaaaaagggtcatcacactgaaacggtgttcaaccgggttttgccagggcctattgcaccagagagcagcaagaagcgggcccgtaggatgcgaccagacctttctaagatgatggccctcatgcagggtggaagcactgggtctctatctctgcataacacgttccaacacagcagtagtggcctacagtctgtgtcatctttgggtcacagcagtgccacttctgcatctttgccttttatgccatttgtgatgggtggtgcaccatcatcccctcatgtagactccagcaccatgcttcatcaccaccaccaccacccccacccccaccatcaccaccatcaccatccaggcttgagagcccctggctacccctcttcaccagtgactaccgcctctggtactaccttgcggttgccaccactgcaacctgaggaggatgacgatgaggatgaagaagatgatgatgacttatctcagggctatgatagctcagaaagggacttctcactcattgatgatcctatgatgccagctaactcagactccagtgaagatgctgatgactgaagccccagcatgggccccattgcttgggcggctgctgtattttcatttactctggcccttggactatggaaacgtgggaggggcaggggagatgtggggaagtccaggactccaggaggtgaaaaggaaaaaaaaaaaaaaatgtacctgattgctcccaattatgagaggattgggtgggcaggggaactcctaaaataatacatgaccacttcctcatttctggggaaggaaaggagactagagcagctggtgtgctcacccctccctagtcacctccattaaccacagactatgtagcgctggccctagcctctggcagagcctgttcctggccgaactgtggatacagctggagggtcaggaactgttaccttctttccccttggcattaataaatttaagttaatccttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 40 - DNA, 6453 bp, Homo sapiens
tacaaccaggctcaactgttgcatggtagcagatttgcaaacatgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttacgtagaatatattggaaggaaaaaaatctcgcctcccacaccaaagccccggccacctcggcctcttcctgttgcaccaggttcttcgaaaactgaagcagatgttgaacaacaagctttgactctcccggatcttgcagagcagtttgcccctcctgacattgccccgcctcttcttatcaagctcgtggaagccattgaaaagaaaggtctggaatgttcaactctatacagaacacagagctccagcaacctggcagaattacgacagcttcttgattgtgatacaccctccgtggacttggaaatgatcgatgtgcacgttttggctgacgctttcaaacgctatctcctggacttaccaaatcctgtcattccagcagccgtttacagtgaaatgatttctttagctccagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccagctctgataatactgaaaacctcataaaagttatagaaattttaatctcaactgaatggaatgaacgacagcctgcaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtggtatgttggttaccctcctagctttccatttggtttagaacataaagcaaatagacacagtcatactgtcactgctctggactgtgtggagctcgctaaagtcatggtcattgcaggaatccaagtggcagtccttctcattcattctaatcattgtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcaaccataatatggtcactaccctaatagactaaatgaaatcttgcaatttcaaattactctttctccatattagatttacccacagctatatttctgtttaagtactagggtgagggttttctgttactttgttttttaatgttgttccttttgaaagaatcagtcttgcagctgagtgaaaaatctgtggaatgtattatttgtcctctttacatgaaactactcatacttaagcaaaagtcagtcttatagcaagactgttagccctcaaacttgactctactgatctgaccatttccctctcatcgccagacaactgacgatttccctggttttagtctgcgtctctgctttaaagttattgtgatatccttctagatcatacacaagtctaacagttaattagttaacagtttttaaactaggtttgtgggtatttttttggtagcacatgtatgctattacatacaaatttttatttctaaaatataagatctgagattgaatattttcattaaaagctacagttttgtgaatctttgtgcttcaacattctttgcaagatgatacggtatttaggcatttgccttatttttgcatctcacaaacataagtgcaatagatcttttcattgaacagcaaagtaggattcatcattccatatgacttgagttacaccagacctgttctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgcagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatgtgtgtgtgtgtgtgtgtgtgtgtgtatatatatatatatatatatatatatatatatatatatatgtgtgtgtatatatatatatatgtgtatatatatatgtatatacatatatgtatatatatgcacatatatatatgtatttaaaaaaatcaaaacaaaaaaaaactcatttatacctgtgtattttttaaagctacaatctgttcaatgtttttaaaaatctgtttatatgacattgttaaaataaagttggtcttttgacgagagggaggatgtcacggtcagttgtaactttgccttcacaaggcaactggggtggggggtgggggtagtgtgcctccttgacatttcgttcaagttatagattcaatggagctatgtcttgttttaagttgctttaatgcattgtattagatcttcaaacagaataaaggttgttttgaaactgaaaaaaaaaaaaaaaaaa

SEQ ID NO: 41 - DNA, 763 bp, Homo sapiens
ttttttttttttttttttgaaaataaaccactgatttattcttattttatttctcctcctgtaatattcacagtgataatttcttgtggaggggaaaaatagtttccagaaagcagagtctaagacaacagctagcacacctgccgtttattttggaaagtgatcatagggaataggagtagggagcttaaaagagtgaaatggggaagaggaaaatagaagggtatgcagctatgggcttatgcggcccacagagtcttccatggaccatgtagaatatctgagggaaagatcagttacctgctacagtctttcattaattgtgttttagcgggttagtaacaccttcacatcggtttgcagcatgtaagcgatttgtctcttggttctaccaagtagccaaaattagtatcagagaatccccagaacagaaagtgaaagtgagcagagctgagaggccagattgtatccatacagtgttggtggccgcaggatgtgaaggtggtcagagaacttgaggagggacacaagtggtatttcatatataactcctcatagaagctatgtgctgtcagtgattctagagacttgaaagcaattcagtccaaggtacttctgtctccaagcccaacatttgaaggacaatggcttaagtaattctctaatatggtaaagcccaatgtctaagtcacctcattgtaatagatctacaacagacatctgtaagatccccaatagtgatttttatgctaaacacccaatt

SEQ ID NO: 42 - DNA, 4852 bp, Homo sapiens
acagattgacttgatgcacaacatcacaaaggcgatttttgagaactgatagtgcatcagccgacccaggtaatttaaaatattcttcatccagagatagaggtggttcttcctcttacggactgcaaccttcaaattcagctgtggtgtctcggcaaaggcacgatgataccagagtccacgctgacatacagaatgacgaaaaggagagatcgatgtcttattgtgatgagtctcgactgtcatatcttcttcggaggatcacccgggaaaacgaccgagaccgaagattggctactgtaaagcagttgaaagaatttattcagcaaccagaaaataagctggtactagttaaacaattggatatcttggctgctgtacatgatgtgcttaatgaaagtagcaaattgcttcaggagttgagacaggagggagcttgctgtctcggccttctttgtgcttctctgagctatgaggctgagaagatcttcaagtggatttttagcaaatttagctcatctgcaaaagatgaagttaaactcctctacttatgtgccacctacaaagcactagagactgtaggagaaaagaaagccttttcatctgtaatgcagcttgtaatgaccagcctgcagtcaattcttgaaaatgtggatacaccagaattgctttgcaaatgtgttaagtgcattcttttggtggctcgatgttaccctcatattttcagcactaattttagggatacagttggtatattagttggatggcatagagatcatactcagaaaccttcgctcacgcagcaggtatctgggtggttgcagagtttggagccattttgggtagctgatcttgcattttctacgcctctacttggtcagtttctagaagacatggaagcatatgctgaggacctcagccatgtggcctctggggaatcagtggatgaagacgtccctcctccatcagtgtcattaccaaagctggctgcgcttctccgggtatttagtactgtggtgaggagcactggggaaagcctcagcccaattcgggccctccaattactgaggcatacgtaacagatgtgctgtacagagtaatgagatgtgtgacggctgcaaaccaggtgtttttttctgaggctgtgttgacagctgctaatgagcgtgttggtgttttgctcggcagcttggatcctagcatgactatacattgtgacatggtcattacatatggattagaccaactggagaattgccagacttgtggtaccgattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccgtgctgtttatcaagcagtgctcagcttgaagaatattcctgttttggagactgcctataagttaatattgggagaaatgacttgtgccctaaacaacctcctgcacagtctgcaacttcctgagtcctgttctgaaataaaacatgaggcttttaagaatcatgtgttcaatgtagacaatgcaaaatttgtagttaaatttgacctcagtgccctgactacaattggaaatgccaaaaactcactaatagggatgtgggcgctatctccaactgtctttgcacttctgagtaagaatctgatgattgtgcacagtgacctggctgttcacttccctgccattcagtatgctgtgctctacacattgtatcctcattgtaccaggcatgatcactttatctttagtagcctcagttcttcctctccttctttgtttgatggagctgtgattggcactgtaactacggccacaaagaaacatttctcaattatattaaatcttctgggaatgttacttaagaaagataaccaggacacgaggaaactgttaatgacttgggctttggaagtagctgttgtaatgaagaagtccgaaacatatgcacctttattctgtcttccgtctttccataaattttgcaaaggccttttagctgacactctcgttgaagatgtgaatatctgtctgcaggcatgcagcagtctacatgctctatcctcttccttgccagatgatcttttacagagatgtgttgatgtttgccgtgttcaactagtgcaccgtggaacttgtattcgacaagcatttggaaaactgttgaaatcaattcctttaggtgttgtcctaagcgataacaatcacacagaaattcaagaaatttctttagcattaagaagtcacatgagtaaagcaccaagtaatacattccacccccaagatttctctgatgttattagttttattttgtatgggaactctcatagaacagggaaggacaattggttggaaagactgttctatagctgccagagactggataagcgtgaccagtcaacaattccacgcaatctcctgaagacagatgctatcctttggcagtgggccatatgggaagctgcacaattcactgttctttctaagctgagaaccccactgggcagagctcaagacaccttccagacaattgaaggtatcattcgaagtctcgcaggtcacacattaaaccctgatcaggatgttagtcagtggacaactgcagacagtgatgaaggccatggtaacaaccaacttagacttgttcttcttctgcagtatctggaaaatctggagaaattaatgtataatgcatacgagggatgtgctaatgccttaacttcacctcccaaggtcattagaacttttttgtataccaatcgccaaacttgtcaggactggctaacgcggattcgactctccatcatgagggtaggattgttggcaggccagcctgcagtgacagtgagacatggctttgacttgcttacagagatgaaaacaaccagcctatctcaggggaatgaattggaagtaagcattatgatggtggtagaagcactatgtgaacttcattgtcctgaagctatacagggaattgctgtctggtcatcatctattgttggaaaacatcttctgtggattaactcagtggctcaacaggctgaagggaggtttgaaaaggcctctgtggagtaccaggaacacctgtgtgccatgacaggtgttgattgctgcatctccagctttgacaaatcggtgctcaccttagccagtgctgggtgtaagagtgccagcctgaaacattgtctgaatggtgaatccagaaaaagtgtgctgtccaaaccgactgactcttcccctgaggttataaattatttaggaaacaaagcatgtgagtgctacatctcaactgccgattgggctgctgtgcaggaatggcagaacgctatccatgacttgaaaaagagtaccagtagcacttccctcaacctgaaagctgacttcaactatataaaatcattaagcagctttgagtctggaaaatttgtcaaatgtaccgagcaattagaattgttaccaggagaaaatatcaatctacttgctggaggatcaaaagaaaaaatagacatgaaaaaactgcttcgtaacatgtgaagtccagatccaagggaacctcagaaatccattgaagttccattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcgtctgctttggagaccacagtttctaacagactttcaacagaggactgtcttattccactcttcggcgaagctttacgttcatgtaaacagcatgacgtgaggccgtggatgcaggcattaaggtatactgtgtaccagaatcagttgttggagaaaattaaagtatgatctcgtgaaatcttgagagaaactgaatgacgaatgaaactattgttcctgtttcacacagaagaaaactgaggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggtgagtgagtgcagacagatggggcctggtgcccttgagcagttcccgggtctcagctgccacacatctcatagccggtgatgctgggggaagcttacgcagtcacagtactggcttcttcctctttttctttccatacaagtggcttagggatggggtagagtagttgacttatttggatgaaaaccactatcttctgtcagaaactcaaaaggaatcattgctggcatggtaacctaaagaaaaacaaccagacaagtgcccaacgacacttaaaaaggtgatttattatcttgccaagtttaggctgggcatggtgactcatgcctctaatcccagcattttgggaggctgaggctggtggatcaccggaggccaggactttgagaccagcctgaccaatatggcaaaacctcgtccctactaaaaatacaaaaattagccgggcatggtggtgtgagcctgtagtcccagctactcaggaggctgagacaggagaattgcttagattcaggaggtgggggttttagtgggccgagatcacgccattgcactccagactgtgcgacagagcgagactctgtcaaaaaaaaaaaa

SEQ ID NO: 43 - DNA, 2230 bp, Homo sapiens
cttggagacaacatgtggttcttgacaactctgctcctttgggttccagttgatgggcaagtggacaccacaaaggcagtgatcactttgcagcctccatgggtcagcgtgttccaagaggaaaccgtaaccttgcattgtgaggtgctccatctgcctgggagcagctctacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggctggctactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatctgtcactgtgaaagagctatttccagctccagtgctgaatgcatctgtgacatccccactcctggaggggaatctggtcaccctgagctgtgaaacaaagttgctcttgcagaggcctggtttgcagctttacttctccttctacatgggcagcaagaccctgcgaggcaggaacacatcctctgaataccaaatactaactgctagaagagaagactctgggttatactggtgcgaggctgccacagaggatggaaatgtccttaagcgcagccctgagttggagcttcaagtgcttggcctccagttaccaactcctgtctggtttcatgtccttttctatctggcagtgggaataatgtttttagtgaacactgttctctgggtgacaatacgtaaagaactgaaaagaaagaaaaagtgggatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgcccacttgctccccgtgagcactgcgtacaaacatccaaaagttcaacaacaccagaactgtgtgtctcatggtatgtaactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagccaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctgtttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacatagctgaggtaaaaactgaactatgtaaatgactctactaaaagtttagggaaaaaaaacaggaggagtatgacacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 44 - DNA, 397 bp, Homo sapiens
tttttttttttttttttagttttactcctggtaagatttattacagtgaaaggataaagagtgagatcaacaacgggaaaaagtgcgtggggcaaaggctgggagaaaccacgcacaagcttccacgggtccttgcccagtggattcgcatggaacatgtttaattccccaggcaaggagttgtgacatgtgtgaaatgtctactaaggaagctccttagaaactcaatgttcagcattttactgggggctggtcacacaggccgcctctaacaggtatatatcaaaatttcagactgtgccacaggaaagcagatgttcaccacacaccacatggatcctatcaacagtttgggtggagtgagccgctcttaccagttggtaatggcaagaactct

SEQ ID NO: 45 - DNA, 597 bp, Homo sapiens
atggagaccggcaggcaaacaggtgtgtctgctgagatgctcgccatgccccgaggtctgaagggcagcaagaaggatggaatccctgaggacctagacgggaacttggaagcacccagggatcaggaaggtgagctcaggagtgaggatgtcatggacctcacagaaggtgacagtgaggcctcagcctcagctcctcctgcagccaaaagacggaaaacacatacgaaaggcaagaaggagagcaagcccaccgtggatgcggaggaggctcagaggatgacaaccctgctgtctgccatgtctgaggagcagctgtcccgctacgaagtgtgtcgccggtcagcgttcccgagagcacgcgttgcgggtctgatgcgggctatcactggcagttcggtgtcggagaacgcggccattgccatggctggaatagccaagctttttgttggagaggtggtggaagaggccctggacgtgtgtgagatgtggggagagacgctcccgctgcagcccaagcatttaagggaggccgttcgcaggttaaagcccaagggcctcttccccaacagcaactgcaaaagaatcatgttctag

SEQ ID NO: 46 - DNA, 377 bp, Homo sapiens
  misc_feature (360)..(360): n is a, c, g, or t
  misc_feature (368)..(368): n is a, c, g, or t
  misc_feature (372)..(372): n is a, c, g, or t
ttttttttttttttaaatgcctatttatagctttcatcctttttggactgcttatgtttttcttattgatctgtagtagcttgttatatgttaactgttggaatttcatatgtgttagagatattgtccccagcttgtcatttgcctcctggttatgtttgctgatccagtgcagaaccccatggggtgcagagtaggaggacatgagagagccaaggctggagagttaggcacaggctaggtcacctaagggctagctgctcatgcaaaggagcaaggaggtgctattgacgagggtaggactttaaaatatctagggagtgaagtcttcaggttttgctgactggataaagggatgtnggatccangaangtgat

SEQ ID NO: 47 - DNA, 1973 bp, Homo sapiens
ctttgaaaaagacttcttttgagctaactttcttatactggtacctttctaatctcactacaatatgtaacattggtgttcgatctcaagtatttctgaatatattcccctatccacagaaatatactctgggggaaaaaaaatagaacaaattcttgccgtcctgaccattgaacaagagactaattagacaatggggctagaaaaacctcaaagtaaactggaaggaggcatgcatccccagctgataccttcggttattgctgtagttttcatcttacttctcagtgtctgttttattgcaagttgtttggtgactcatcacaacttttcacgctgtaagagaggcacaggagtgcacaagttagagcaccatgcaaagctcaaatgcatcaaagagaaatcagaactgaaaagtgctgaagggagcacctggaactgttgtcctattgactggagagccttccagtccaactgctattttcctcttactgacaacaagacgtgggctgagagtgaaaggaactgttcagggatgggggcccatctgatgaccatcagcacggaagctgagcagaactttattattcagtttctggatagacggctttcctatttccttggacttagagatgagaatgccaaaggtcagtggcgttgggtggaccagacgccatttaacccacgcagagtattctggcataagaatgaacccgacaactctcagggagaaaactgtgttgttcttgtttataaccaagataaatgggcctggaatgatgttccttgtaactttgaagcaagtaggatttgtaaaatacctggaacaacattgaactagaaactcagaaagtggtccttgtgatggaaagagaaaagaaaaaccaattagaataaggcagaatgtacgtgcgtcattggaacacagaaaacatgctggttcatacagcgtttttagtcataatggtcttttttattttgtttgattcattcgagacaacatgtgtgtatgtgtgtgtgtgtgtgtgtagataatgtggtttttgtatggtgtttgatggaaggaataatctttctttgctttcttagtagtatttcaaggtgtttacttttcaattggtgtgcactgaatgcatgtatggaagaatagcgtgaataatgcaatctctttgtcatttttccccttctcagactcttagctcttaaaattcaaagatgggatattctaactggtagtggtgcatcatttttaacccaaatattgcaagcactttaaagatttgaaaccacatttttattgtttgatgtttcattttcagactttttaatgtcagtcattacaattacattgcatgaggaaaatttttccagaacaacagtgtggaatagttctgaattatgctgttctacagatagaaaaaaagtccaaatgcctttaaaaatttacttcttactccacccaacacgtttttgcaaagcaagaagtctttgtaagacaccttaaacaaagtccttcaattctacagcagaggaaataaaatcccccagaagccaaagggctcaccttcacattgttagttcatgacagacccaggtgtgcttcattagagataacatacattccctttggtatcacaggaagttactggggattactcgacctcattacttagctaacgactggataaaatttcttaattgtttgaagtaacattgtattcgtgtttgcattattaatttgaatagaaaataatcacattttcaacccatttatacaaattgttaatgtttctttagagctgtataactatagtttgaactagcaaggaagttattgttttgacaaccagaaattatgcttttctggtgcatgaaacattaattgcaaagggcagtcacatccaactttaataaaatatggtggtctttcttaaaaaaaaaaaaaaaaaaaaaaaaaaaaaaaaaaaaaaaaa

SEQ ID NO: 48 - DNA, 2334 bp, Homo sapiens
aagcagtagtaagatttattgcaaagaacaaaagaacaaagcttccacaatgcggaaaggaacccgagcgggttgccactgctgcctggggcagcctgcttttattctcttatctggccccacccacatcctgctgattggtagagccaagtggtctgttttgacagggcgctgattggtgcgtttacaatccctgatctagacacaaaggttctccacgtccccaccagattagctagatacagagtgtggacacaaaggttctccaaggccccaccagagtagctagatacagaatgtcgattggtgcattcacaaaccctgagctagacacagggtgctgattggtgtgttcacaaaccttgagctagatacagagtgccgattggtgtatttacaatccctgagctagacacaaaggttctccacgtccccagcagactcaggagcccagctggcttcacccagtggatcccgcaccggggctgcagatggagctgcctgccagtcccgtgccctgtgcctgcactcctcaacccttgggtcgttgatgggactggacaccatggagcagggggtggggctcgtggaggaggcttgggccgcacaggagcccacggagggggtgggaggctcaggcatggcgggctgcaggtcccgagccctgccccacgggaaggcagctaaggcccggcgagaaatcgagcgcagcgccggtgggctggcactgctgggggacccagcacaccctcagcagccgctggcccgggtgctaagcccctcattgcccggagccggcagggcccgccagctgctccgagtgcggggcccaccaagcccacgcccacccggaactccagctggcccgcaagcgccccgcgcagccccggttcccgctcgcgcctctccctccacacctccctgcaagctgagggagcgggctccggccttggccagcccagaaaggggctcccacagtgcagcggtgggctgaagggctcctcaagtgccgccaaagtgggagcccaggcagaggaggcgccgagagcgagcgagggctgtgaggactgccagcacgctgtcacctctcaccagcactttgggaggctgaggcgggtggatcacgaggtcaggagatcgagaccatcctggctaacacggcgaaaccctgtctctactaaaaatacaaaaaaattagacgagtgtggtggcaagtgcctgtagtcccagctactcaggaggctgaggcaagagaatggcgtgaacgtaggcagcagagcttgtagtgagccgagatcgtgccactgcactccagactgtgcgacagagcgagagactccgtctcaaaaaaaaaaaaaaaaaaaatctataaactggtgcaccggtaccggtccccatctccccaggttatgaggaacaaatgagataatccacagagcaggcgaaacacattgagtaagccactgttatttactaagaagacaggctcacggaatggttgcggcagcctcattagttcctttgcgaagtgcagacacccgctctctgtttcattgattcctaaatgcattttgttcacatcttaacacctctgaaatcaggatgagtcctaaaatcgatagcttcttaacattttagtttgcagcaatctttcccttcatagtgacaccagataatcgtgcatcgcttagactgaatgaatgcaattgattcattatacaatgaaatgtagatatatgacatatacacacatataccatgtgtaccatcgtaactaagagaccactctagataagctatagaaagtataaaaatcattttactttaatacaaaatcacataaagaaaggcatgttggctaaatcaaatattcactaaatatcagtgaagtcaccactggaatctcaatagcacattttcctgctttcttttctcccttctgctaaccattgaagaccagggtcatccgtgggagcagatgagtaggacacgcgtctgcacgctggaggccctgggggttgacatgggagcaggaagtggacccccccaccctgcacatcccttctgtttttcttgatttcagtctcactggcccaggccaaatcttcaagggtgtctagttctgcagccagggagaaagtgatgccaagagaacctcgtctcctccctcctcagtctgctttgaaggggaaataaatacacaggcctagtgtgtctgtgtggcacagggaggtggttttgccaggcatcttggaaggttgtcttctagaatcagagccatagccttacttgtggccttggatctaggtctgtttccccgatcgaaaaaagaac

SEQ ID NO: 49 - DNA, 463 bp, Homo sapiens
gtgtcagaagcatttattcaaattcattcatcagcaaacctaagccactgctactattagaattacaaatggcactgcaaaataggaggttctcttccaattgctataagggacaaggcaggatcctttattggctgatgaacctgaaggagtataggttacaattctgacttttattggggccggagatgactaaaagaatgaaaacaaatttgtgtctgagggcggtattcactggggagaaatatttcaaaaactttccttctcctggagggaaccaatcagaaaaaaatgtaatgtgaatctatttctgctatgcaaagcaacggagcttcatgtttctggtttcaacatggaatagagggagttacaggggcaaggacagtggtgagtaggcgcctctgagatgtcttctctccttcacctccgtacctttgtttcacagtgtgcaacgtgtatctca

SEQ ID NO: 50 - DNA, 475 bp, Homo sapiens
  misc_feature (464)..(464): n is a, c, g, or t
gttgagttgatcaccaacaaacaatgatttaatcaaaaatgcctatataatgaaacctcaataaaaactgaagaggacaggattcagagaatctctaggttggtgaaaaatagtggtgttgggagagttggtatacccagtgagggtatggaagctctgtgccacccaccccccagcccaataccttgacctgtgcatctcttccatctggctgtttctgagttttatgtgaagactcggggacacagggacacacaagggaaatgcgatgtgactatggagacacagattagagtgatgggtccacaggtctcagggtcctcaaacaaccaccagaagataggaagaggcaaggatcataccctagagccttcagagacagcatggcccagctgacatcttgaattcagacatctagcctccagaacctccaaagaataaatgtctattgttttaaaccaaanaaaaaaaaaaa

SEQ ID NO: 51 - DNA, 1315 bp, Homo sapiens
cacttccgtccagaccggaacccaagatggctgcgctgttgctgagacacgttggtcgtcattgcctccgagcccactttagccctcagctctgtatcagaaatgctgttcctttgggaaccacggccaaagaagagatggagcggttctggaataagaatataggttcaaaccgtcctctgtctccccacattactatctacagttggtctcttcccatggcgatgtccatctgccaccgtggcactggtattgctttgagtgcaggggtctctctttttggcatgtcggccctgttactccctgggaactttgagtcttatttggaacttgtgaagtccctgtgtctggggccagcactgatccacacagctaagtttgcacttgtcttccctctcatgtatcatacctggaatgggatccgacacttgatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagttttccccttgtttctaaagatgaggtggctgcaaaaactccccttttttgcccacagcttgcctactctcggcctagaagcagttattctctctccatattgggctttgatttgtgctgagggtcagcttttggctccttcttcctgagacagtggaaacaatgccagctctgtggcttctgccctggggatgggccgggttggggggtgggttgggtgaagctttgggttgccactgcctgtgggtttgctggcttaaaggacaattctctttcattggtgagagcccaggccattaacaactaacacagtgttattgaaagaagagaggtgggggtggaggggaattagtctgtcccagctagagggagataaagagggctagttagttcttggagcagctgcttttgaggagaaaatatatagctttggacacgaggaagatctagaaaattatcattgaacatattaatggttatttctttttcttggatttccagaaaagcctcttaattttatgctttctcatcgaagtaatgtaccctttttttctgaaactgaattaaatactcattttaaaaaaaaaaaaaaaaaaaaa

SEQ ID NO: 52 - DNA, 2051 bp, Homo sapiens
agatcagctgatgccggagggtttgaagccgcgccgcgagggagcgaggtcgcagtgacagcggcgggcgatcggacccaggctgccccgccgtacccgcctgcgtcccgcgctcccgccccagcatgacagccccggcgggtccgcgcggctcagagaccgagcggcttctgacccccaaccccgggtatgggacccaggcggggccttcaccggcccctccgacacccccagaagaggaagaccttcgccgtcgtctcaaatactttttcatgagtccctgcgacaagtttcgagccaagggccgcaagccctgcaagctgatgctgcaagtggtcaagatcctggtggtcacggtgcagctcatcctgtttgggctcagtaatcagctggctgtgacattccgggaagagaacaccatcgccttccgacacctcttcctgctgggctactcggacggagcggatgacaccttcgcagcctacacgcgggagcagctgtaccaggccatcttccatgctgtggaccagtacctggcgttgcctgacgtgtcactgggccggtatgcgtatgtccgtggtgggggtgacccttggaccaatggctcagggcttgctctctgccagcggtactaccaccgaggccacgtggacccggccaacgacacatttgacattgatccgatggtggttactgactgcatccaggtggatccccccgagcggccccctccgccccccagcgacgatctcaccctcttggaaagcagctccagttacaagaacctcacgctcaaattccacaagctggtcaatgtcaccatccacttccggctgaagaccattaacctccagagcctcatcaataatgagatcccggactgctataccttcagcgtcctgatcacgtttgacaacaaagcacacagtgggcggatccccatcagcctggagacccaggcccacatccaggagtgtaagcaccccagtgtcttccagcacggagacaacagcttccggctcctgtttgacgtggtggtcatcctcacctgctccctgtccttcctcctctgcgcccgctcactccttcgaggcttcctgctgcagaacgagtttgtggggttcatgtggcggcagcggggacgggtcatcagcctgtgggagcggctggaatttgtcaatggctggtacatcctgctcgtcaccagcgatgtgctcaccatctcgggcaccatcatgaagatcggcatcgaggccaagaacttggcgagctacgacgtctgcagcatcctcctgggcacctcgacgctgctggtgtgggtgggcgtgatccgctacctgaccttcttccacaactacaatatcctcatcgccacactgcgggtggccctgcccagcgtcatgcgcttctgctgctgcgtggctgtcatctacctgggctactgcttctgtggctggatcgtgctggggccctatcatgtgaagttccgctcactctccatggtgtctgagtgcctgttctcgctcatcaatggggacgacatgtttgtgacgttcgccgccatgcaggcgcagcagggccgcagcagcctggtgtggctcttctcccagctctacctttactccttcatcagcctcttcatctacatggtgctcagcctcttcatcgcgctcatcaccggcgcctacgacaccatcaagcatcccggcggcgcaggcgcagaggagagcgagctgcaggcctacatcgcacagtgccaggacagccccacctccggcaagttccgccgcgggagcggctcggcctgcagccttctctgctgctgcggaagggacccctcggaggagcattcgctgctggtgaattgattcgacctgactgccgttggaccgtaggccctggactgcagagacccccgcccccgaccccgcttatttatttgtagggtttgcttttaaggatcggctccctgtcgcgcccgaggagggcctggacctttcgtgtcggacccttgggggcggggagactgggtggggagggtgttgaataaa

SEQ ID NO: 53 - DNA, 863 bp, Homo sapiens
tttttttttttatccagaggcccttattgtctgcttcctttctcagctgaacccctggccccagagcccccagcacggccctctaaggtggagcagctccaagatgagaccaaccacctaaggaaggagctggagagtgtgggaagacagctccaggctgaggtggaaaacaatcagatgttgagtctcctgaacaggagacaggaggagaggctgcaggaacaggaggggtggcaggaggaacaggagaggctgctggacaaggtggaggagctgctggaacaggagaggttttcgggagcaggatgagaggctgtggcagcaggagactctacgggagctggagaggatgctggagttggggtgggaagccctctacaagcagcgggccgagccccacagcggcttcgaggagctggtgcaataatgagaacaagagtgcactgcagttggagcagcaagtaaaggagctgaagcttggagaacctggaagctaccagccagtagaaacagcagctaaagcccagttgagcctcatggctctccctggggaaggagatggaggaggacatctggacagtgagcaggaggcgcctcggcccatgccgaacatcccaggggacctggagagccgggaggccatggtggcatttttcaactccgctggagccaatgcccaggaggagcaaagggtgtgctgccagcccctggctcacccagtggcctcgtcccagaaaaagccagaggtagcggccccagccccagagactgggggtgaatctgtgtgtggggagacccaccaggccctgcagggggccatggagaagctgcagcgactttatggaaggagaaggtggacctga

SEQ ID NO: 54 - DNA, 6127 bp, Homo sapiens
tgcctcgtccgccggctacgtctgcgtttccgcctttccttttgtttttctcaggttttgcgtgggaggcggtcccgggatttcaagggtctacgcgcttttctatggcgaatgcaacccgacgagggagtgggctgtatcttcagagttgtctccgtctttccaagaacagaacaaaatgaacaaggtagaacagaagtcccaggagtcagtatcatttaaagatgtgactgtgggcttcacccaggaggagtggcagcacctggaccctagtcagagggctctgtatagagatgtgatgctggagaactacagcaaccttgtctcagtggggtattgtgttcacaaaccagaggtgatcttcaggctgcaacaaggagaagagccatggaaacaggaggaagaattcccaagccaaagctttccagtctggacagctgatcacctgaaagagaggagccaagaaaaccaatctaaacatttgtgggaagttgtattcatcaataatgaaatgctgactaaggaacaaggtgatgtaataggaataccatttaatgtggatgtaagttcttttccttccagaaaaatgttctgtcagtgtgattcatgtggaatgagtttcaacactgtttcagaattggttatcagtaagataaactatttaggaaaaaagtctgatgaatttaatgcctgtgggaaattgttactcaatattaagcatgatgaaactcatactcaagagaaaaatgaagttttgaaaaataggaacacactgagtcatcatgaggagactttgcagcatgagaagattcaaactttagagcacaattttgaatacagtatatgtcaggaaaccctccttgaaaaggcagtattcaatacacagaagagagagaacgcagaagagaataactgtgattataatgaatttgggagaactttgtgtgatagttcatccctcttgttccatcagatatctccgtcaagggacaatcactatgaatttagtgattgtgagaagttcttatgtgtgaagtccaccctttctaaacctcatggggtatctatgaaacactatgattgtggtgaaagtgggaataatttcaggaggaaattgtgtctgtcacaccttcagaaaggtgataaaggagagaaacactttgaatgtaatgaatgtgggaaagctttctgggagaagtcacatctcactcgacatcagagggtgcacacaggacagaaaccctttcaatgtaatgaatgtgaaaaagctttctgggataagtcaaacctcactaaacatcaaagatcacacacaggggagaaaccttttgaatgcaatgaatgtgggaaagcctttagccataagtcagccctcacattacaccagagaacacatacaggggagaaaccctatcaatgtaatgcgtgtgggaaaactttttgccagaaatctgacctcactaaacatcagagaacacacacagggctgaaaccctatgaatgttatgaatgtggaaaatccttccgtgtgacttcgcaccttaaagtacaccagagaactcacacaggtgagaaaccttttgaatgtcttgagtgtgggaaatcctttagtgaaaagtcaaatcttacacagcatcagagaattcacataggagataaatcttatgaatgtaatgcatgtgggaaaactttctaccacaagtcattactcaccaggcatcagataattcatacagggtggaaaccttatgaatgttatgaatgtgggaaaaccttctgcttgaagtcagacctcacagtacatcagagaacacacacagggcagaaaccctttgcatgtcccgaatgtgggaaattctttagccataagtcaaccctctctcaacattatagaacacacacaggggagaaaccctacgaatgtcatgaatgtggaaaaatcttttacaataaatcatacctaactaaacataatagaacacatacaggggagaaaccctatgaatgtaatgaatgtggaaaagccttctaccagaagtcacaactcactcagcatcagagaattcacataggggagaaaccctataaatgtaatgagtgtggaaaagctttctgccataagtcagctctaattgtacatcagagaacccatacacaagaaaagccctataaatgtaatgaatgtggaaaatctttctgtgtaaaatcaggacttattttccatgagagaaagcacacgggggagaaaccctatgaatgcaatgaatgtgggaaattcttcaggcacaaatcatcactcacagtacatcacagggctcacacaggagagaaatcttgtcaatgtaatgaatgtggaaaaatcttttaccgtaaatcggaacttgctcaacatcagagatcacatacaggggaaaagccctatgaatgtaacacatgcaggaaaactttctctcaaaagtcaaatctcattgtacatcagagaagacatataggagaaaaccttatgaatgaaatggatattagaaatttccagccacaagtcagcctccataatgcctcagagtattcacactgtggagaaagccctgatgacatcctgaatgttcagtaactatccacaaactcaccttatgttactccaaagtaatagtaggggataaacccatagactacaacaattataggacagcttttgttaggaagtgatattctatgtaatatcagatggttaatacgggcataacaccttacagattttttttgaatttgtgaaagtttttggcaaaaatgcaaataaggttatgttagaatttacactgaggagaaaattgtcaatttaagaaatctaaagtgaaaattttgcttagaaataaaatacgacaagttatgttttgagtttgatgccataatagtttttagggcacctaacaataatttatagatgtatattgtggaatgtaaagctttaagaacttaaacaaaggtaataattaaaataacctcacaagaagtttaatgagtagagagaattcccatgtacacttcaccaaacttcctctaaggataatgtataatcatagtatatggtcaagtccaagaaatcgatgttaccttgctggtagatagagacttagtcagattttactatggtttgcatgcactctgtgtgtgtgtgtacgtgtatgtgtgtgtgtgtggttatatcaaacttttacgacttttacatttgagtaaccatcaacacgattagtttacagaactgaaaaggaatctgagatctgtactgtatcaggattacaaaggatttagcctcaagtagttccctttttgtattaataaccacacgctttctgcaaccctatcccttgcatccacttgactatgaagtttttttaaagcacagataaattgaataatcagggcaatagcattaagcacatctgcgaattatccctgaagttcaaaagacttatatatgtataagtggtatgtgatataaatcgtgtgtttcatatgcataatggaatttaacgtaattgtgaataggaagtaggtatcctagtttagtagtggttacattatcaggcccatcccagatgtttgtgatgtcctgaaacaatttaaaaggagacccacagagctaatgtttatccatttaaaaggtataaatcaaaataacaaattatctaaaaaaaatctatcctgtacatgtgaagatctaggctcgcctccatgttactccctttctcttcctacctgtggctcatgccatgccatgaagtgcctagggtacatatgtgaacattccagccttcagcataagtggtagtccaaattttctttaagcagctgctctccaagacagggccctggaaaggcccacacatacagcccagggctgcccagggctgttggactgtcatttcaaggctcattgtccccagacagggatctgggccctcagacttttgagaatatgaagaggagggttgaggctggagcagaaccagaatcaagctggtgtggggcttttattgatagtgtgaagattgtacactatattacatgatcagatcatacaaataatctaagattatacagtctagtgatcctagattacacaagtaatctaagcttccactttaggaaactagaaaaagaagagcaaattaaatccaaagtaacctgaaaaaacattagagtaaaaatcattgaaattgaaaagagaaaatcgataaaacccaaaactggttccttgaaaaggtcagtaaaattgataaacctctagctagcttaagaacaaacagaagacaaatattgctaataccaaaaatgaaagaggccatcacagctaatcctatggtcaccaaaaggattagaaagaaacatggacaactctgtccataaatttgataacttagctaaaatggaccaattccttgcaagacgcattctctcaaagctcacacaagatagacctcaataggcatatgtatctattaaataaaccaaagcagtaattaataaccttccaaggccaggtacagtggttcatgcctgtaatcccagcacttcactttgggaggctgaggcgggtggatcacaaggtcaggagttcgagaccagcctggtcaacatggtgaaaccccctatctactaaaaatacaaaaaattagctgggcatggtggcatgcgtgtgtagtcgaagctactcaggaggctgaggcagaagaatcacttgaacctgggaggtggatgttgcagtgagctgagattgtgccactgtactgcagcctgggtgacagaatgagactgcatctcaaaaaataataatgaaactttccaaaacaaagtgccaggaccagctgggttcactgatgtgtttttgagatacttaaggtagaaatgataccaagtctctaccatctctttcagaaaataaaagcagagataacacttcccaactcattttgtgaggccagtattaccctaatagcaaaaccaggcaaagatattacaagaaaggaaaactacagatcaatatttccattgaacacagatgcagaaatcctcaaaatattagcaaatcaggaatgcaaggcttgttcaacatttgatattcagtgtaatccattgcatgcattagcagctcaaagatgaaatacgatcatatcaataggtacagaaaaagcatttgacaaaatccaatatccattcatgttaaaacctctcaacacagaaggaatacaggagaacttactcaagttggtaaagaacatactacaaaaaaccctacagctaacattatccttgatgtttccaactagacactttcctactaagatcaggaacatggcaaggaacaccacaccactgcttttcagcattgtactggaagtgctatataatgcagtgttaaaaaaaaaagaaataaaatgcacatagatttgaaaggatgaaatacaactttgttcacaagtaacatgattgtctttgtagagaattctaaataacaaaaaccctgctgacattaataagcaattacagcaggattgcaggatacagtcctcaggtagatgataaaaaggaattggacatcaagtcattaaaagacacggagaaaccctaaatgcttattgttaagtgaaaaccaatctgaaaaggctttctattttgtatgattgcaattatatgacattttgggagaggcaaaactattgagccagtgaaaggaccagtggttgctgagagttgaggggaaaggagggatggcaggtagagaggtgatttttaaggcagtgaaagtactctctagggtactgtaatttgtcaaaacgcagagaatggaaaacagtgaacggaaaacacagagtaaaccctaatgtcaactctggacttcagttaataataatgtatcactgttggctcattaattgtaacaaatgaaccataatgatgcaagatgttaatgattggggagcctgtggaagatgggaggggaaagggttatatgagaattctctatactttttgctcaactttctgtaaccctaaagctactctaaaaaatgaagtgtatcaagtaaataaataaccaaccaaccaaccctgaggaacaaaaaaaaaa

SEQ ID NO: 55 - DNA, 662 bp, Homo sapiens
tttttttttttttttattgtgttgatgcatttcatttgtttttagggttcagggctgtagagaaagaatcagcagaaaactatttcaggccaaaccacaagtgtttcttgcaggggaacagataacctgaagtgatctctgcaagtcttgcttaaatttccagtagatggcatagtgaaaagggtagagaagtagcattttagtctttgttggccatttccaatcctgtgtttggcagcaaagcatttgaagacataaaagagttggccttgcctctcaagtttatagtgtggggagacaaaatgaacacatgggacatcacacacgctaaaactcaatgcccgttccatggcggcagctcagatgcaatccaggaatgaaacatacacagtttgtaaagagaactgtcagtttcagaatgggagaagagtgcatcctggaggaacgcgtaagaagtaggatgattcaaatagcatagtatgttgtccaggagttttttttaaccacctgctactaggagttcccaaagtaataggaacttccttagatggttgttaatgaagggaaatgaagtcagatgtctctggatttgaatcttgactcttcatagttgagtaactttggacaagtcccctaatctgcctctgacagggcctgcctga

SEQ ID NO: 56 - DNA, 6907 bp, Homo sapiens
ccgcccagccaggtgcaaaatgccgtgtcattgggagactccgcagccggagcattagattacagctcgacggagctcgggaagggcggcgggggtggaagatgagcagaagcccctgttctcggaacgccggctgacaagcggggtgagcgcagccggggcggggacccagcctagcccactggagcagccgggggtggcccgttcccctttaagagcaactgctctaagccaggagccagagattcgagccggcctcgcccagccagccctctccagcgaggggacccacaagcggcgcctcggccctcccgacctttccgagccctctttgcgccctgggcgcacggggccctacacgcgccaagcatgctgagggtcttcatcctctatgccgagaacgtccacacacccgacaccgacatcagcgatgcctactgctccgcggtgtttgcaggggtgaagaagagaaccaaagtcatcaagaacagcgtgaaccctgtatggaatgagggatttgaatgggacctcaagggcatccccctggaccagggctctgagcttcatgtggtggtcaaagaccatgagacgatggggaggaacaggttcctgggggaagccaaggtcccactccgagaggtcctcgccacccctagtctgtccgccagcttcaatgcccccctgctggacaccaagaagcagcccacaggggcctcgctggtcctgcaggtgtcctacacaccgctgcctggagctgtgcccctgttcccgccccctactcctctggagccctccccgactctgcctgacctggatgtagtggcagacacaggaggagaggaagacacagaggaccagggactcactggagatgaggcggagccattcctggatcaaagcggaggcccgggggctcccaccaccccaaggaaactaccttcacgtcctccgccccactaccccgggatcaaaagaaagcgaagtgcgcctacatctagaaagctgctgtcagacaaaccgcaggatttccagatcagggtccaggtgatcgaggggcgccagctgccgggggtgaacatcaagcctgtggtcaaggttaccgctgcagggcagaccaagcggacgcggatccacaagggaaacagcccactcttcaatgagactcttttcttcaacttgtttgactctcctggggagctgtttgatgagcccatctttatcacggtggtagactctcgttctctcaggacagatgctctcctcggggagttccggatggacgtgggcaccatttacagagagccccggcacgcctatctcaggaagtggctgctgctctcagaccctgatgacttctctgctggggccagaggctacctgaaaacaagcctttgtgtgctggggcctggggacgaagcgcctctggagagaaaagacccctctgaagacaaggaggacattgaaagcaacctgctccggcccacaggcgtagccctgcgaggagcccacttctgcctgaaggtcttccgggccgaggacttgccgcagatggacgatgccgtgatggacaacgtgaaacagatctttggcttcgagagtaacaagaagaacttggtggacccctttgtggaggtcagctttgcggggaaaatgctgtgcagcaagatcttggagaagacggccaaccctcagtggaaccagaacatcacactgcctgccatgtttccctccatgtgcgaaaaaatgaggattcgtatcatagactgggaccgcctgactcacaatgacatcgtggctaccacctacctgagtatgtcgaaaatctctgcccctggaggagaaatagaagaggagcctgcaggtgctgtcaagccttcgaaagcctcagacttggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcagccagcctctgggtgacatccatgagacaccctctgccacccacctggaccagtacctgtaccagctgcgcacccatcacctgagccaaatcactgaggctgccctggccctgaagctcggccacagtgagctccctgcagctctggagcaggcggaggactggctcctgcgtctgcgtgccctggcagaggagccccagaacagcctgccggacatcgtcatctggatgctgcagggagacaagcgtgtggcataccagcgggtgcccgcccaccaagtcctcttctcccggcggggtgccaactactgtggcaagaattgtgggaagctacagacaatctttctgaaatatccgatggagaaggtgcctggcgcccggatgccagtgcagatacgggtcaagctgtggtttgggctctctgtggatgagaaggagttcaaccagtttgctgaggggaagctgtctgtctttgctgaaacctatgagaacgagactaagttggcccttgttgggaactggggcacaacgggcctcacctaccccaagttttctgacgtcacgggcaagatcaagctacccaaggacagcttccgcccctcggccggctggacctgggctggagattggttcgtgtgtccggagaagactctgctccatgacatggacgccggtcacctgagcttcgtggaagaggtgtttgagaaccagacccggcttcccggaggccagtggatctacatgagtgacaactacaccgatgtgaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaaggcacaggcaggcggaggcggagggcgagggctgggagtacgcctctctttttggctggaagttccacctcgagtaccgcaagacagatgccttccgccgccgccgctggcgccgtcgcatggagccactggagaagacggggcctgcagctgtgtttgcccttgagggggccctgggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccaggaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccagagttgctaacatggagctctgagatcaccccacttccatcatttccttctcccccaacccaacgcttttttggatcagctcagacatatttcagtataaaacagttggaaccacaaaaaaaaaaaaaaaaaaaaaaaaa

SEQ ID NO: 57 - DNA, 524 bp, Homo sapiens
  misc_feature (221)..(221): n is a, c, g, or t
tcctattcaagaactttacagattttattgcaagtaaaaagcacgaatccctccccgattcgtcctgcagggtcccaggtttgctgtggttcttttcttgttctctagacttttcttggggttagcggtggctcagcccccagcaggtcacaagtgtccctttttacttctcttcgttcttggtgctcatgagggctcggtaacccgggctttgagggcanaggggtcaaagcttgggtccaaccagctttgctgcgctagagccctctgcagccgcttggactgcactgcgccctctcgcccgcaccgaggccccggcacctctccaccccttcgtggagtgcactgccatccacagacaaagtctgcacgtgtggggtcaaagagagaccctcgcggagacccagagtgccgggagagcagaaggcaggggagtccacacagggcaagcagcaaccaggcttctgaggacaggaaaggagggagcatctggtgggaagctggcgaggaggggctgggagctg

SEQ ID NO: 58 - DNA, 363 bp, Homo sapiens
  misc_feature (20)..(20): n is a, c, g, or t
aagaaccctgttccccaggnaactgccccaacacctcgagcaggtgcctcccctctccaatgaagcctctcccgtccgcccggcccagaaactgggcaacttactggtttcggcattttcggtttctgggacacactgctgtttgggcaaccctttgtcagggcctgttatctcccacttgcagatccagggcatttcagaggtcagagagaggagggaggcctcttctgagattttgacctctattcaggttctacattcatggaatcagccaaccttggatggaaaagatttggaaaataataaaaataatactacaattaaaataccaataaaaatccaatacagaaaaaaaaaaaaaaa

SEQ ID NO: 59 - DNA, 441 bp, Homo sapiens
tttttttttttttttttcacttttgtttagatggggaaaataactgaatgcctgtatctcccaagtaaggaatgattcagtatagagagaaaattgatgatgtagcagagagaaagataaattgctggaagaatgtccttgaaaagacaaaagaaaatggatgtttatctaagctaatgtacacagaggcagaatctgtggtgcagatgctggtgggggatagatgtggttgtgagaatctgtggaaagtctctgtttccatttttctagagaattagaaacaagattatctgtctagagcaagaatagtgaaggaggcattggtagtctgagagtcatctaggagaatagcagagtgtgcaagtgtagggaaagccaatattacagtgaatgcttcaatcgcatctttgttgaatgtgatggaaggagaagcctagggaa

SEQ ID NO: 60 - DNA, 527 bp, Homo sapiens
agctgtgggaggtttcaggtgctttcattttcaaaagaagtcaagcacatattatgcttggaacaagcctagctttctaatgaaaagagactgcaactgaatcatcaaacaaatataaacaaatagatcaataaatgtgcatgcatacacgtgttcacagaggacaatttgaaggtgaaacatgaaatgagagcgcgcacggaggtgccagccatgagatgtgcagaggccaagagcgcagggccagggtcaggaggatgtgcagtggagccgggtaaatgttactgccgcgccctaagaaacggggaggggagggggcaggtctggaaccacctaggaggcagatttggctgatttgtttcaggaatcctttctgccttgtgatttaggagttaacgtttccttctcctctttctgctcctccttcctccaataaagtgcgtgaccttcatcagtgcacacacaggtggcactggctcagggcccatcgagggccagtgtcctgggccctgccagggcatgtctgt

SEQ ID NO: 61 - DNA, 185 bp, Homo sapiens
ctggccgatctctgtttattttttatgatgtcccttgagtgatacaaaatcttcatggttggtttcttcccctcagtacacaagaagcaacacgagctctttctgatacagaaggagttcaggtcacttaaggcatgtgggtgatggttgctgagcaaatcatcccgtaggtatccatgacaaag

SEQ ID NO: 62 - DNA, 359 bp, Homo sapiens
tttttttttttttttttgctttcttatttcctttatggattgagccagctagtgcaagcagaaagtcaaggccacagtgagtttggtgggaagccaagtgtaagagagtcaggattaaaaggctggaggggcagaggaggccagcacaggagacgaggagaaggggcttagaagaaaggagacctggggagctgaactgcacctgctccttgtgcctgctcttgtcagttactggggacattgataggctgaccctggagcagctgcctgccttgccccaaaacactgattcattctggatggttctttctcgatatctctttttttggtctcaatacttggcttgtgaggatggaaac

SEQ ID NO: 63 - DNA, 663 bp, Homo sapiens
gtgaaaaaaggacagaagcaaaggctacacaaaacaaagccagacctggagatcattttcaaactcttccctcctcacccaaaatacatgaaaagcccttctgtaaagcaactgatgtcttcaacttactatgaaacggagatgaataactcagcttgatgaaggaaccctcatgtccactcaattaatgattgggcacctaccctgggtcagagggcttttggaggtacagagttcctggccttgacgaaggtaaagaaagagacatgtcctatgctgaccttttggataatagagcatggcaaattggagtcttcaattaagcacacggaatacatgtgctgaattgctttctttgcaaggttcagagtcagaattcctgccctgggttctgagttgctgagtggagacgatgatggagagcagtggagacacgtgattttcagggtgctctttgcatgcatgaaatggagcaagacttatgaagggaaaatgaaaaaggaggataggaagatacgtcacctcctgggtttcctccaatcatccagtcctcatctctctatatgtctttgaacactctgagcgccatcatgccaattccatggatgaaacaaatacccatgactcagcatttttctaatgaaaacacatgcggtctgaccc

SEQ ID NO: 64 - DNA, 3406 bp, Homo sapiens
gcggccacacgcagctagccggagcccggaccaggcgcctgtgcctcctcctcgtccctcgccgcgtccgcgaagcctggagccggcgggagccccgcgctcgccatgtcgggcgagctcagcaacaggttccaaggagggaaggcgttcggcttgctcaaagcccggcaggagaggaggctggccgagatcaaccgggagtttctgtgtgaccagaagtacagtgatgaagagaaccttccagaaaagctcacagccttcaaagagaagtacatggagtttgacctgaacaatgaaggcgagattgacctgatgtctttaaagaggatgatggagaagcttggtgtccccaagacccacctggagatgaagaagatgatctcagaggtgacaggaggggtcagtgacactatatcctaccgagactttgtgaacatgatgctggggaaacggtcggctgtcctcaagttagtcatgatgtttgaaggaaaagccaacgagagcagccccaagccagttggcccccctccagagagagacattgctagcctgccctgaggaccccgcctggactccccagccttcccaccccatacctccctcccgatcttgctgcccttcttgacacactgtgatctctctctctctcatttgtttggtcattgagggtttgtttgtgttttcatcaatgtctttgtaaagcacaaattatctgccttaaaggggctctgggtcggggaatcctgagccttgggtcccctccctctcttcttccctccttccccgctccctgtgcagaagggctgacatcaaaccaaaaactagagggggcagggccagggcagggaggcttccagcctgtgttcccctcacttggaggaaccagcactctccatcctttcagaaagtctccaagccaagttcaggctcactgacctggctctgacgaggaccccaggccactctgagaagaccttggagtagggacaaggctgcagggcctctttcgggtttccttggacagtgccatggctccagtgctctggtgtcacccaggacacagccactcggggccccgctgccccagctgatccccactcattccacacctcttctcatcctcagtgatgtgaaggtgggaaggaaaggagcttggcattgggagcccttcaagaaggtaccagaaggaaccctccagtcctgctctctggccacacctgtgcaggcagctgagaggcagcgtgcagccctactgtcccttactggggcagcagagggcttcggaggcagaagtgaggcctggggttttgggggaaaggtcagctcagtgctgttccaccttttagggaggttactgaggggaccaggatgggagaatgaggagtaaaatgctcacggcaaagtcagcagcactggtaagccaagactgagaaatacaaggttgcttgtctgaccccaatctgcttgaaacctgactctgcttctctcatttgtcttcctaccctactcacataattcactcattgactcactcattcaccagatatttattgacctgctattataagctttacatcctcccatgttgtcctggcatgtgcagtatacacggtctaactcatctctccccagatctctcagaaccttgagcttgggaattgaactggggtcacctgtgtcctttcttatggactcgcaggattttagaaccctaatgcaccctggagggtagctgggccagacttctcatttcacaggtgaggagactggtgccccacagggattaagtgccttgcccaaggtcaggcttatctccagagggaggtgccctggactggggcccagatgttcagggaccctgcctacacctcatttccagtgtgggctgccttagttagttatgagaacagggaagggctgggaagagacagcctccaaggtcaacacttggagagggtttcacttgctctgaagaccctggtccaggattcgccctctcccatgccttcaagtcagcatcaggcttagggcaaagaccaggcctctgaagctgcctcttgtaattcatgcaggaagatgtcaaagtcagccccatcttggctgatcagggtgttcagccttaaccccacctgtgttctgaagtctcttaccctacctgctcaggactgagacagttattcactgaacatatttattaagcacttgctgtaggccaacagttaagaatccaataatgaaatggacagattcatggaacttagagtccaataggaaagtgagacccagacaatgacaatgagataaatgttaggaagggggaggtatggggtgacttccctgcagtcctgggggcctagatgggcccaagactgggtgagagtcttggcagagcctttgcaacaccttaagtggacaggactgggaggtcttggtggttggagccaacgtgggttccctgcggctccttagtcacctctgatagcagattgagggaggaaaacaggtaaggcatgaggaaatggccaggttgggttaacccactggtttcaaccagttcaggaatgaggttatttggccatgactggctgatcttgagctcaaggatctgcttcaaatgcacacaggcctagttgaagtttaaaccccagcaaaacattcctccctgtaaatggaaaatcctacttctacccccaccctgccctgttttttgttttttttttccccaagatcattagatgtcctcacccctcctcactgcctctcctctctgggacaggctgggacctttgaggaagataaagccttccttgactacccatcatattcagtgtccctgttcctcactcagagaggaaggcagaaccagtcaggcttatttcagtaagttccacagttctacaagactgcaggaattctccttaagggaggagagcaagcaggtgtggccccagcttctggaaatggcagaagagagggttttctcattgaatgggggtgggggctcgtgtgtcctgggaaaccccatcagtcccttcatttcttgagactcaactcctgggaggagagggtctcaagagttgtccctggaaggagggcgggggcagtctgcatctatttcaggttgtggctcttggttctaggactcttacttctctggctaagggctcagcttcttgggacttcaaccatcttctttctgaaagaccaaatctaatgtaaccagtaacgtgaggactgccaagtatggctttgtccctatgactcagaggagggtttgtcgggcaaattcaggtggatgaagtatgtgtgtgcgtgtgcatgggagtgtgcgtggactgggatatcatctctacagcctgcaaataaaccagacaaacttaccaacgtcaaaaaaaaaaaaaaaaaa

SEQ ID NO: 65 - DNA, 676 bp, Homo sapiens
ccgccaactttttttccttagagaatcgtttttgtggtacatgtgggttagataagcattatcaccttggcttctctaatatggggctaatagtacataccacacagagttggtagtattaaatgtaacaatctaaggcactagaacaatgctgaacacataatagtgagtccaaagtctcaggactcttcactgatgctgcttctactattggaccctggaactcaacaatggcaaaagaaataattcagagacccctctccccaacacacatacctgctgcttggcccctgatcttttacttcctgaaacaggctgttctgataaatgtctattaatttggtgcagggaaggtgtaaggggaaagagttaagtgggtcactttgaagctaatatagtctaattacccacattctggtcattccattgtggctagaaggctctcagtctcccctctgggcctctgtccctctgccaacaatgtcctctctcctttccttcctctactcagagcttaagtcactttttaaccccaaacccaactcatttcttgcctcctctccagccacctgaacctcacttttgtcttggccaatgcaatacgttttgctttttcaagtctctagaagcagactcagcaaactatgacccatgagcaaaatcctgtctttcccac

SEQ ID NO: 66 - DNA, 1549 bp, Homo sapiens
gggagcggtggggcacgattcagtccactgcacaccgttctcctctccagacctctcactggcaagtcctttcatctcaatttcagttctgtgaggccgtcctactattgtctatcaccctgtttgatttttttgtagcctcatcatttattcattacagtttcttaagttctttttttttagggagcttgtcattgcctagaagagtgctgggcacacaatagtgatactgaatatacaactaaaatcatgtaatatagcacatgagattcttaatgctaaaattaagactttttaacatgaaaaatgctcttaagggcagaaatgaagcacatttcaggcaagatggcagacaagactgaaacggattcatccatcaactgctacagacttaaaaaacaatatgcccaatgcaaagctgagctcaggaaatcctcagatgctagagataaagacaaaatccagttgcagaagtgagttccaggtgatgccaggagaccccaggaagtatcagattaggtcacaaaactaggaataaggttttaatgtcttcagaaaaacagagcatttggtgagagaagggaactaatccgagactcccgcattcaaccaggacacttgaagggctgcctcacctgtgaaaaagaaactggaaaaatctcttcaaatctgtctgtggaaacagaaagacagcctggtgtttgacaaagctctcggtgggacaaacctcctctgagaaatggaaacctaggaaatcaaaagcccagaaattaagggaaagcattagtctcagataacgaaaaggaaacccttggggcccgggccaaagcaaatgtaaaaacatgaacacttgcataatctcgtacatgggactcacagaaaacgcaacccctaatatagatgagctcgcaatgaaaaattatccaccactgtggcaatgcagtcaccaaaaggaagactcaacagaccaatgagcatagacacgagctgtggaggtaacaactggaaacagaagaataaaatctcaagataaataatttaaaaatacttaacatggaaaaatatttcacttaaaaaatataacttttagaaaaaatatagtatcattaacttaaaaattcagtagctaggttgaacaataaattcaccacaaatgaaaagagaattagagatctggatcacggagctggaagatgaatgcagaggcagcacagggaggtaaagcaatggaaaagatcgcagggagtcccaagacccgggatgctccctcgagtcactcacaggagctccagaggaaaggacagatcatggggaaaggcaatatttgaagcaacaatgactgggaatttttcataattaagaaagatgtaaatattcagagggaaaatgcagatctagacacttttcagaaacactatgaaactccaaagtcaaggaaaagattaaaagcaactagaaacaaaagacagtttacaataaaagatccaaattagatggaaaaaaaaaaaaaaaaaaaaaaaaaaaaaaaaaaaaaaaaaaaaaaaaaaaa

SEQ ID NO: 67 - DNA, 928 bp, Homo sapiens
gctgtggccctggcacctgcccctgggctgggacagcccactgttccatgctgcccaagaaggctcagcacaggcacaaaccattgcccggcactggcccgtgctgcctgagaaggattggcacgggcacagaccactgcccccacctgccctgcgccatctacccaagaaggctcggcacgggcaccaaccactgcctccaactgccccatgctgcctgagaaggcactgcacggccacccccaactgccccgcactgtccctacccgggcagccatgcgagcggctggaactctgctggccttctgctgcctggtcttgagcaccactgggggcccttccccagatacttgttcccaggaccttaactcacgtgtgaagccaggatttcctaaaacaataaagaccaatgacccaggagtcctccaagcagccagatacagtgttgaaaagttcaacaactgcacgaacgacatgttcttgttcaaggagtcccgcatcacaagggccctagttcagatagtgaaaggcctgaaatatatgctggaggtggaaattggcagaactacctgcaagaaaaaccagcacctgcgtctggatgactgtgacttccaaaccaaccacaccttgaagcagactctgagctgctactctgaagtctgggtcgtgccctggctccagcacttcgaggtgcctgttctccgttgtcactgacccccgcctcttcagcaagaccacagccatgacaaacaccaggatgcatgctccttgtcccctcccacccgcctcatgacccagcctcacagaccctctcaggcctctgacgagtgagcgggtgaagtgccactgggtcaccgcagggcagctggaatggcagcatggtagcacctcctaacagattaaatagatcacatttgcttctaaaatt

SEQ ID NO: 68 - DNA, 1254 bp, Homo sapiens
ctcacttggccttacactccgctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggcccctgccgggcgccccagcgcctctcgcgggcaccgaaagcgcagccgcagggttctctaccctcgagtggtccggcgccagctgccagtcgaggaaccgaacccagccaaaaggcttctctttctgctgctcaccatcgtcttctgccagatcctgatggctgaagagggtgtgccggcgcccctgcctccagaggacgcccctaacgccgcatccctggcgcccacccctgtgtccgccgtcctcgagccctttaatctgacttcggagccctcggactacgctctggacctcagcactttcctccagcaacacccggccgccttctaactgtgactccccgcactccccaaaaagaatccgaaaaaccacaaagaaacaccaggcgtacctggtgcgcgagagcgtatccccaactgggacttccgaggcaacttgaactcagaacactacagcggagacgccacccggtgcttgaggcgggaccgaggcgcacagagaccgaggcgcatagagaccgaggcacagcccagctggggctaggcccggtgggaaggagagcgtcgttaatttatttcttattgctcctaattaatatttatatgtatttatgtacgtcctcctaggtgatggagatgtgtacgtaatatttattttaacttatgcaagggtgtgagatgttccccctgctgtaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttactgtctgcaaaaaaaaaaaaaaa

SEQ ID NO: 69 - DNA, 2010 bp, Homo sapiens
gtgctgccgcgggtcacgtgctgcggaggcttggggaggggcggcgaggcggggtttatagcccgggcgcccgcgggccccacgctttgaccgggtcgtggcagccggagtcgtcttcgggacgcgcctgctcttcgcctttcgctgcagtccgtcgatttctttctccaggaagaaaaatggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaaggggctagacaggattgaggagagactgcctattctgaatcagccatcaactcagattgttgccaatgccaaaggcgctgtgactggggcaaaagatgctgtgacgactactgtgactggggccaaggattctgtggccagcacgatcacaggggtgatggacaagaccaaaggggcagtgactggcagtgtggagaagaccaagtctgtggtcagtggcagcattaacacagtcttggggagtcggatgatgcagctcgtgagcagtggcgtagaaaatgcactcaccaaatcagagctgttggtagaacagtacctccctctcactgaggaagaactagaaaaagaagcaaaaaaagttgaaggatttgatctggttcagaagccaagttattatgttagactgggatccctgtctaccaagcttcactcccgtgcctaccagcaggctctcagcagggttaaagaagctaagcaaaaaagccaacagaccatttctcagctccattctactgttcacctgattgaatttgccaggaagaatgtgtatagtgccaatcagaaaattcaggatgctcaggataagctctacctctcatgggtagagtggaaaaggagcattggatatgatgatactgatgagtcccactgtgctgagcacattgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaaagaagtgtctgacagcctcctcacttctagcaaggggcagctgcagaaaatgaaggaatctttagatgacgtgatggattatcttgttaacaacacgcccctcaactggctggtaggtcccttttatcctcagctgactgagtctcagaatgctcaggaccaaggtgcagagatggacaagagcagccaggagacccagcgatctgagcataaaactcattaaacctgcccctatcactagtgcatgctgtggccagacagatgacaccttttgttatgttgaaattaacttgctaggcaaccctaaattgggaagcaagtagctagtataaaggccctcaattgtagttgtttccagctgaattaagagctttaaagtttctggcattagcagatgatttctgttcacctggtaagaaaagaatgataggcttgtcagagcctatagccagaactcagaaaaaattcaaatgcacttatgttctcattctatggccattgtgttgcctctgttactgtttgtattgaataaaaacatcttcatgtgggctggggtagaaactggtgtctgctctggtgtgatctgaaaaggcgtcttcactgctttatctcatgatgcttgcttgtaaaacttgattttagtttttcatttctcaaataggaatactacctttgaattcaataaaattcactgcaggatagaccagttaaaaaaaaaaaaaaaaaaaaaaaaaaaaaaa

SEQ ID NO: 70 - DNA, 1898 bp, Homo sapiens
gacatttgacattttattgtagcagctttctgggttaatatctctttgtgattgatagaagtggttggaagaggaagagtagggaaaagtgtgacattacagattaaacagtgaaaatcagtaccataatgactcctttacacccatgagatacgtaccatgatgaccagggctcggtgaaagaaagatttctttttttttttttgagatagtctcactttgttgcccagtctggagtgcagtggcgcaatctcggctcacggcaacctctgcctcccgggttcaagtgattctcctgtctcagcctcccaagtagctgggactacaggtgcatgccaccacacctggctaatttttgtatttttagtggagacagggagtcaccatgttggccaggctggtctcgatctcctgacctcaagtgatccagctgcctcagcctcccaaagtgctgagattacaggcgtgagccactgtgcccagccaaaagaacgatttcttagatggaggacctaggaaccaacagatgggctgctgtattactcttacccctttcattttcctgtatgcttcttcccaaggcagcatcaaattttgaattaatttttgctgcttaataaggacttaaactggtacccaagtcagaaagactctgcctctaattttctggggcttggggatgaagataaagtgttacacccagtgtttgtccaccacagtctgtggggcagagagacccttcctgggactgaattctcaatttgaagcactgttgttcaaagatctcccttctgggtctgacaagaagaaacataacccttatttattgcattcttctggcttacatacattgccctcactaatcaatggacatttcagcatttcattactaattttgagagaaggccaccatggaatttaataaaaatattattgaagagaattgccatcattctccattttccctgaactaccacaagcttctcagaattttagacaaatgtttttcccctcagaactgagcatcagtgctgctttggaaaaacattccatgtgaatactgtggtttcagtgtcaggacctgtacttgggcagttggaagagagtgtgccagttttttactgggagatgggaacaccaatttaattgatgcaattaggttgtaggttttttacagtttttcttttcttttctttttctttttcttttcttttcttttctttttttttttttgagacataggctggctctgtcacctaggctggaatacaatggcatgatctcggcttactgcaacctccgcctcctaggttcaagcaattctgcctcggcctcccaaatagcagggattacaggcacctgccaccactcccagctaattttttgtatttttattagagatgaggtttcgccatgttggccaggctggtcttgaactcctgacctgaggtgatccacccgtctcggcctcccaaagtgctgggattataggcatgagccaccgcacccggccggttttctacagttttctaatactcaagatgttgactttgacaatacttatgtttgtatacttgtaatcttataatggggaaaatgtgtataaagatgttttaatatgtatgtagtttttcaataaatcttaatgccttgaagggaagatttgctgtccagcttgaatgctcattcttgggtcagtgcctgtctaaccttgaggagcatttcattttcaggttatctccatcccagggaaaccctctgggtctaaactgagaagctgctgcaattgtcccctcactggcttctcagtcctagtgaattgatcaagttaacttaccaagtggtttgggttcagctcaggtgaagaggataattgagtttacataaatggtaccttc

SEQ ID NO: 71 - DNA, 284 bp, Homo sapiens
ttttttttttaaagaaagaactttgttttattcactgttgaatctacatagctggaagagttcctggcaaaacaaatgggaagagataaaatgggattcaggaaagatttcacaaaggtgattatacccccagagagtttagaaggatgcaagagattatcataaaaagataagggagctgggaatagctggcagaagtgtgttcaaaggtaagaaagattaaaaccacatggtttgtttaaataatgtgagatattggttgggcgtaaacccttcatttgtgc

SEQ ID NO: 72 - DNA, 450 bp, Homo sapiens
ttttgagtgtctaagtgggtggcggcgctgtttattgagctggttgatgtaatggtattactttttcctaaagtctgagttactcaggactaataaaacagtaatcaaattccaattggcatttgatcttccaactgtagcacaatatttaaatcacgaaatacaacatgtagcaagtgttccttctgcttttggattatctaaggtcaagagtaagaacctgtaatagtgagctgtacccacacttatcttctccaaggaccaatgttcattactacaaacacatctcagcttcatattaaggaatacaattatttctcttgttggcctttcttggctatagagattcaaggtaaacatctaaaatgacagctttttctgctgccttaagacagatgacctttgtgtttatgtgttttcccccataattctctcagtaagctgcaaggc

SEQ ID NO: 73 - DNA, 9035 bp, Homo sapiens
ggaggcgcgccccccggctgggcgccgcgcgcaccatggggctcccagcgctcgagttcagcgactgctgcctcgatagtccgcacttccgagagacgctcaagtcgcacgaagcagagctggacaagaccaacaaattcatcaaggagctcatcaaggacgggaagtcactcataagcgcgctcaagaatttgtcttcagcgaagcggaagtttgcagattccttaaatgaatttaaatttcagtgcataggagatgcagaaacagatgatgagatgtgtatagcaagatctttgcaggagtttgccactgtcctcaggaatcttgaagatgaacggatacggatgattgagaatgccagcgaggtgctcatcactcccttggagaagtttcgaaaggaacagatcggggctgccaaggaagccaaaaagaagtatgacaaagagacagaaaagtattgtggcatcttagaaaaacacttgaatttgtcttccaaaaagaaagaatctcagcttcaggaggcagacagccaagtggacctggtccggcagcatttctatgaagtatccctggaatatgtcttcaaggtgcaggaagtccaagagagaaagatgtttgagtttgtggagcctctgctggccttcctgcaaggactcttcactttctatcaccatggttacgaactggccaaggatttcggggacttcaagacacagttaaccattagcatacagaacacaagaaatcgctttgaaggcactagatcagaagtggaatcactgatgaaaaagatgaaggagaatccccttgagcacaagaccatcagtccctacaccatggagggatacctctacgtgcaggagaaacgtcactttggaacttcttgggtgaagcactactgtacatatcaacgggattccaaacaaatcaccatggtaccatttgaccaaaagtcaggaggaaaagggggagaagatgaatcagttatcctcaaatcctgcacacggcggaaaacagactccattgagaagaggttttgctttgatgtggaagcagtagacaggccaggggttatcaccatgcaagctttgtcggaagaggaccggaggctctggatggaagccatggatggccgggaacctgtctacaactcgaacaaagacagccagagtgaagggactgcgcagttggacagcattggcttcagcataatcaggaaatgcatccatgctgtggaaaccagagggatcaacgagcaagggctgtatcgaattgtgggtgtcaactccagagtgcagaagttgctgagtgtcctgatggaccccaagactgcttctgagacagaaacagatatctgtgctgaatgggagataaagaccatcactagtgctctgaagacctacctaagaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactccccccgaatccaagcccaacttcacccctctcgccatcttggcccatgttctcggcgccatccagccctatgcccacctcatccacgtccagcgactcatcccccgtcaggtctgttgcagggtttgtttggttttctgttgctgccgttgttctctcattggctcggtcctctcttcatgcagtgttcagcctcctcgtcaactttgttccctgccatccaaacctgcacttgctttttgacaggccagaagaagcggtacatgaagactccagcacaccgttccggaaggcaaaagccttgtatgcctgcaaagctgaacatgactcagaactttcgttcacagcaggcacggtcttcgataatgttcacccatctcaggagcctggctggttggaggggactctgaacggaaagactggcctcatccctgagaattacgtggagttcctctaaccgtgggccccagcagaactgctgagctttacatggtatccatgacaactgctgattccagtgtcgaggccatttctctttgccactgagaaatgcagcgtgactgactctgttgctacctgtcaacatgaatgtttctgtgagctctggtgtcactcatctccatgatcatctcagccaacatgcatcagtactgcaagaaaagaagtcaatcagcagaggagagcatttgataactaagaggaagacttgcaaagccgttttctcatgagtaccctgaatagggggcactcattttgtttcaacggtccaaacgcccaaccttcagaaagaggaagtcagatagaaatagtccctgagagcacactgtgtagctaagcctgctggggctgggtgaagaaattggcgctgagatccaggctggatccattgcttttgtttacaataggcactctctctaccccacctctcagtacttgagacttaaagtgctacaggcagctggatctgtttgcatgcaggatgaagagggttaaaacactgtttatataagatccaatctctcaccatctctaaagcagccgttggcctgtcatcagtgagatacaatccagtcttctcatgcacgggaacacacacaccctgcgtttctccctcccaggctaggaacctctctgccaccaagggctgccatccatcgcctagtaaccacggcaacccaacctactctaaaaccaaaccaaaaaaataaaataacacatcctctttgcatgacacattttttttctcccctttttggtacactttttttgaatggttttctaacaacttgaagcacaggatcaaggaattagggtggtctacttgaggcagatgggatagtagctgggaactgttccctttctgattaatttcagcagcatcggaatatatttggagcacaccctagtaacctcttgagattaaattacatagtcttaatatttctgttcctccatgcaactgatgtttgttttttaaagggtaagatgctgcctcccaatgggtgatgccatctgactggtttccccatgtcctcccattcacccatctctgctcccacccttgcctgcctctaacccaccactggccagcccccttgccctactctgggctgctgaacactggtgctgtggtggttttcaaggttaattcctaggctaaccgtatggcctatagtttaaaagcacatctatgttcactgccactctgaaaaagggaattatttctcagtctttcaaggcttgagactaatataggccattgtgattcaggaagaaacccaaggttggagggtgggatgagtaccctctgaaaaagggaatttgctggtgaaaagaggctggatcttgtggaagactgtcttggatggggaagtactacctggagatttcaaattcacttggcctgcaaacaacagagttatccgtatcttccacatgtgaatgtcattgcaagggtgactctagacaaactacaaaccgatggaccgtcaagctccccaggagccccttggatggcagcgttgcttcagagtgtttcctgtttctggaattccttgttagggaactttaaagaagaaaagaaaaacttgaattgtgttgaattactgtatcttttacttttttttttttgaaaagataaacttgtaaatagagtgatttgaaatactatatggcaaagttttatatttgatattctttaagttagttgctcacacacttaggctttgattgctgaagaagtatgtttaagagggagagaggggaggcaaagctgaagagagtcaaggtcactgtccccgcttcggcctgaaggaaagagaagacatttctatggccttgctctctgctgtcctgttggtgggcacgacacatcagtggtgttcagtctttatgtgtttttaagcatcccttgggctttggatttggagatgggaagagcatctccaggcaatgagtttttcaaagaatgcctacttagtagtaagatgaagctcaggatttaaataagtggggtcaggcattcgagtttttgtctttcttctcaggtgtatttcttggtacccccaagatatcaggccagaaagagatgagtcagttgctgtgctctttacttctttttctccacatcttctgaggctttagaaatgtggacaagctagttttcaaattttgtgtgcgtctgtaagttcttaaagaaccagcttcttagaatgttcagttctcaatgtgctgctgctttcccttctcctaaacattttaaaactcttccctttcacctccaattcccgtgatcccaaaagaagaggaagactccaggaggggtatagattgtgccgtcatagctttacaggtggttttaaagttaacaggggtttgtcatggtgattcactactcagtttatcagctcaaggattatacagctcttttccgggaactcacccaggagcaagcgagacactaccattgaatcagggaatgagaattaagaatggacaggaccaagacagaactcaagaaagccactggggaaaactcgagaagaaagggagtatactagtaggttagatctgtgaacctgaggacaagaagaccttgggaaatggaggcctcaggggatgtgcattcacatactattacgcttctcaaagagagaccaacatcatgcttttaacacatttgatgaggttttttatttgtgtttttgtttgttttttgagatggagtctcactctgtggcccaggctggagtgcagtggcgcaatcttggctcactgcaacctccacctcccaggttcaagtgattctcctgtctcagcctcccaagtagctgggactacaggcatgagccatcacacccagctagttttttgtatttttagtaaagatggggttttgccatgtttgccaggctgatctcgaactcctgacctcaagtgatctgcccacttcagacccccaaagtgctgggattccaggtgtgagccgctgcggccgaccacatttgatgtttgaagttgtaatctgtcccatcataaacttacctggagctcatgtggaggaacagaaggccaagatccttgctttgggggtgcctcacgaagcatccctgtagacatttggccccagcttcactgcttggaagcatgtccctccctcttgagttggctctgatttgaaatcgggagaaacagagctgctgccaatgggatcttttaggtaactccctccctagcttccgtgtgtctgtgcagtgcccatgagctgctgccaatgggatctttcaggtaccccctccccagcttccctgtggctgtgcggtgcccttgacagatggcttctctgtttccctttgcccagccaggctcccctccttcctattagctacaaaactggataaacttcagaatatgagccaatgagtaggaaggaacttgaagactaaagattttactctctcccctatccatgccccctacctctgactctctctgtgtgaacaggaaactttagggcagatgaggagaatgaattggttatcagagtggaagaccatggcccaggatccctgagctttcccagtagcctccagtttcctttgtaagacccagggatcacttagccatagcctgaatcttttaggggtattaaggtcagcctctcactcttccttcaggttactaacaaaatttcgtagctaaagaatgccatggccgggtgcagtggctcacgcctataatcccagcactttgggaggccgaggcgggcggatcacgaggtcaggagattgagaccatcctggctacgacggtgaaaccccgtctctactaaaaatacaaaaaattagccgggtgtggtggcgggcgcctgtagtcccagctactctggaggctgaggcaggagaatggcatgaacccaggaggcagagattgcagtgagccaagatcacgcccctgcactccagcctgggtgacagagccagactccgtctcaaaggaaaaaaaaaaaaaaaaaaaaagaatgccatgccaggagaagacagctggtttcaaatccctgcccccaggcaagtaaaaccctgacttgctcaagacagaagatcttttctcctgtttttcaaaataaacatatatagggatggaccctgtgcattgtggcctgccttggtgtcctagaattggagccagtctttagcttaatgtctgaagtatttatacggccaatatgtgttttcttatgtcagaccacactgtctttttgaatatcagttcatttcctctcaccgagtgcttttcggtgagaggcaaagagaaagaatgaacaatcaagtattgacagactggcattagcaggacagagccatactagtgacaagggcatcccaaggcacttgcccagagctgcagagttgtgtgtgccatacctgcggctcaaagggaaggccttctatcccctgagtttctatcagctgaaaatggcaactgctgtctcagtaaaagctctgtcttgactgcagaggctccaaaagcattcacagttgagggggagaaagacagaaagaagaagccaaagataacctgatccctgcctgtctgttggcacctgtcatcctctggcttctgctcccaaaagcaagtctggatgactgagttttgtggacatggcactcccggagacagcagtggccaccatggcacccagagtttgcccaagtactgaatgttttgtgagcaaccatgttccccaagtaggtagccagcgctgcagaaaccaaacagcctcttagctacctgactttaaaaggaatgacctaggtgttctgccaaaggagttatctatcatctctggcaaacttgacaatcatcacttacctcgacaaccctgccccacatcactttataaagtcagcaggatgtcttctcacccaccctgtgctggtgtctaacaaatttatcttgtcatgctcaaatgtgtttggcagccacaccgatcggctgggtgctgaaccgcctctctgtaattgtagcatcaaaatgacaacagcagcagagcagcgaatcttgcacagccccacagcatgcctgagacaagactccaacaagtaataattagctttttttctcctgccgcctacagtacctgtctaactaaagagcttcccaaagtggagggaaaggccatagaatccaggtgtcattcagagccagtccttgctgaaatgtggtcttccagtggaagcacctgtattattgagaggaaaaagtgttggatgcaaagtaacaccaggactagagagaaagagaaaggtgaaccatcctaaggagctttggatacttttttagaaggataaatattatgcttactgaggagaaaaaaaaaagcgatcacagaaaaatttcacagctaatatttttacaaaagttgtgccagacattacagagtgaaaacgtctctcaaggtggaatgctttagagagcaaaggcttagcatagacctagacccttgtgtgggtatgacatgacatgacatgtccatgtcaaaattcactttagtcagaaccagagtattgataaacaaaatgtcagttacctggagcagtcctggagaggttaagacattctatactgttctacgtcaaccatttctacaaagttgtccagacacctaaaagcagctttcttggttatccagatgccagaatcaaccttgtatctgacaatgcacatctgttgattctaaagtatatttatgtgtgtgtgtatgtgtgtgtatacagcacatatttacatctatgaagacatagacacttacagagacccacatgagctggcactttctgagcctttacagcctttaagactcggaggttgagaattagagacacaagagaggctgtggatggcctattaaaatgattaaagatgtaaattcagtgccattttaaaactgttcatatttatcaaacaattactgtctacagctacattttttgttaacttacttaaagtcatgtcgcaagaaagatcaaacccatgaatgcttagtagctaaggctagtgttcaaaagcactctaaaagacattttgtccacattttggaaaagaaaatatttgcatgtttaattcataatttaggctatctttgagtatactgtaaagtgctgtgtgatataatatcaataaagtactttggcactttaatgttttcttttaaaataacgcactgttctaaacttcagtattgactattgactcgtgcatagaatccaatgctgtaattagaaagtaatctgtgactagaatagacctttgtccctgttagtagccctgttgccatgttcaggcttttaaaaaatgcttttgtgtcaccaaatatatctataaagaaaacaaaatttctgttcagaggcctctgaaacttggctttcttacatgtggttggtttatgtgacaatccctatgaaatgagtggacgtatgatttttgaattaaatgacttttccatttggtggta

SEQ ID NO: 74 - DNA, 5808 bp, Homo sapiens
aacagactggcggcgcgcggaaaacgcgtcacgtgacgactggccccgcctcttcctctcggtcccatattgaactcgagttggaagaggcgagtccggtctcaaaatggaggtaaaaccgccgcccggtcgcccccagcccgactccggccgtcgccgtcgccgccggggggaggagggccatgatccaaaggaaccagagcagttgagaaaactgtttattggtggtctgagctttgaaactacagatgatagtttacgagaacattttgagaaatggggcacactcacagattgtgtggtaatgagagacccccaaacaaaacgttccaggggctttggttttgtgacttattcttgtgttgaagaggtggatgcagcaatgtgtgctcgaccacacaaggttgatgggcgtgtagtggaaccaaagagagctgtttctagagaggattctgtaaagcctggtgcccatctaacagtgaagaaaatttttgttggtggtattaaagaagatacagaagaatataatttgagagactactttgaaaagtatggcaagattgaaaccatagaagttatggaagacaggcagagtggaaaaaagagaggatttgcttttgtaacttttgatgatcatgatacagttgataaaattgttgttcagaaataccacactattaatgggcataattgtgaagtgaaaaaggccctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaactttaacaaaatgcagtttcgaaggtgtttccttgtgagttaacaagtaaagaagatcattgttaattactattttgtatgaattttgctaaagttaactgtaaagaaacacctgctgacttgcagtttaaggggaatctattctccccatttccaaaccatgatatgaatgggcgctgacatgtggagagaatagataatttgtgtgtttgcaatgtgtgttttagataaataggattgggtatttaaattagcatttgtgaatttaatagcattaagattaccttcaaatgaaaaaaaatctcaaaatttctatttggtttttgtgcattttcttttaaaatgtaatcatatgattttagtgtgttagacttgctgagtcctagctgtgtttagaacatctctattctacatttaccttggtcaaatttgaactgctgccataggttttgggtgtaaagaatgtttactgccctccatttaaattctgaaaagggatggtggatgttttccctctcctacgttagaaaccattcttaaaaacttttgaaaatatagaaccattaagcctgctatatctgagcaaattagtgggtaccttttttttcttatttaaagcacaagaggcccataaatcttgagttactttaaattcttttttttgatacaagttttcagagcaagagaataaaaatcatgtgttattaaacccctaactggctggcatgctttcctgtttgtattctatacattttgctggatgaaaccaaggatagttcaggtataattgtccaaaataacctaactgcagcagaaatgtagcacagttgcttagtacaggcttctcacttcctacagacctgaattcaaatttggatagtctgagttcttaaattcccaaagaacacactgttatttcttgtgtatatttcaacataaatcatgttgttaccaatttgtttggaaggccctggttgagaagagttttagttaataaggtcatatatacatatattaatataaaccaatgtctactgttttgctccagctagtgcttacagtttcattcgagccctgagtatgtgccctgctgttactctctttggtagttgaacgttgaattcaagtcttttgttttaagaagtactaagcaaacaagcaataaaaaggggaatggggtgtgctagtgtttgaatatgctctcttgttgctctaattctgtgcctctgtgcattaatatttggatgcatgcaatgccagcatggaaattggtcttcacacatactgcagttttccagaaacattcacaaaccaataaatgtaacagacattccatttgttaatgggcatatatgtgaaaagcagtgtagaaaataggctaatattagaaaatggttaagtcctaaataacttcaagtgtggttatataatggacactgtcaatgttcataacttaaacctgggtacctggtcaaaataatgcttgggaaacattaaaattgagctaaattgtctcaagttcttttattcatataaataaagtttaaaggaatgggggagattaacatttcctgttttatgtttgtgaaattgtttgacacaaccttgacagtatcctttaatggcatgaggttaattgtactgttaaccaactttctatgttctggaactagtattatagtgaaaacatttacagtaagttgatgtttacaacctataagcaggtgaaatctgtgtatgtgacctgtttataagttgtattagcttagctcttgtgaacagtgtggaaaagtaagccatgaggagagcgatttaaccacctttaaaggacctaagatgtgctttttaagcacagtgtggatcacagaaactcactaagacaggacttcagcagccttttgtgtttggacaagtcagcataaataaagaatgacaaggcagcagcaagagcttcaactacagagaagtgaaggcataagatactatgatgatagtgagcaactttccaaaagctagttaaatctgcttattacaactgaaatatcgaagaaagtctagcaggaaggagctcttcgccttttggaacatcaatgagagatagttgccacagtcactaggtctagcatttagacctgcaaggaagggcaataagcattaggtaaggcttgaatttgaattttttcactaattaaagagtaattttttgtaaagcaaggtaagagtaatctttttgatttgcaggttgaatgagaaccctacttgcctaaatgaggaatgtctttcctaccatctaaaatacgaaggtttctggctgggtaaggtttgtagttgacagtaaaacctgatgacaccatttgtttccctgcaagtctacattacatatttcacaactttgtccctctctagtaggcacattggaaaaattcttcaactgaaaactaccttggtaccatgtcctacacgttttaaaccttagttttaaaaattcccctgcgaaatagccataagtattcatatcaagtcagttgtgactccttgtgtatacaattcattttttgtgtcttcagggtaaactcaatttttggtaaagtggtttcagcttttgtgaaaaccgttttggtgtgtaagcatgacacacaacagactcagtaagctgcccatcctcatactaggaaaacaccttcaaaggaacattaaaagttaccagggccaggcacagtggctcacgcctgtaatcccagcactttgggaggctgaggcagatggatcccaagtccaggaatttgagacgagcctgggcaacatagtgagagcctgtcaacaaaaaatagaaaaattagttgggcttggtgatacacatctgtagtcccagctatttgggaggctgccttgatatcaggcagtcgaggctgcagtgagctgactgccccactgtattccagcctgggtgaccccatctcaaagaagaaaagttaccagatgtcatgggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaataagggctgtttttgctgccccaaaagggcttaacaatttagtcggatagtttacttaaaaaaaaaaatcctttggagacatactgaaaatgcaaactagtttctaaattatcaattccctacatgaagaagcagtttgccagagtttagtctcagaaaatgactggttggctctatttaaatcagaacccaatttctacgcgtgttgaataaggtaacagcctttgatgaatttccttcacaacatggttttagtgaagcaaacattttttttttaagggcattgttctttctagtttatttctttttatgaaataaaattattttatttaaacagttccattgtcgtttctgaaaactacagtattctcagaagttgtagcagcagtaaaaaaaaaaaagttgttatataagtgattggggcagatttaactgattttgttaaaccaatttgtaagttactgcttctaatattacacttctaaaaagctgaatttatactcatgtcctaaaggagaatatgtggtaataaagtatatttgttaagtaactaattgaaataggcttggttttaagagttccagtatataataatcacaaattgaaacctgacagtatcttgggagttccagtaatgtcacaaattagtgaataagcatgccagtgtgcaagggtaatgtaaggattgttagcctatctaaatattcaaaattactttaaaacttaagtatgttttctgatttttaagaattcagaagtgttctgtaatggattcagatgtttcatttgtagtataatgaaatgtttacagaaagataactttttcattaaaatatttttagaaatgtgtgtgttgttttgtcacttcacaatgttcatgtgacttaaacactataggtgaatattttgacttattttaccagtaagtaataaaacaacaggaaacttg

SEQ ID NO: 75 - DNA, 513 bp, Homo sapiens
  misc_feature (494)..(494): n is a, c, g, or t
tttggattttgataagagtttaataatgtgtaggcagacatcaagaaaaccagtaaatttgtacagcaatctcaggctagcaagggctaggagctgttaccaccccttgatctaaagtgtaagaggaggaagaagttgcttgaactcaaagagagtagtttcatagaaagggctacctgacagaaagaactacttttggtggagtgaggtggccaattcgtggcaggccaccagagaatgagcttagagaatatataatgcaacctcattcttctccaccctctcatcccttaccagtgcctctcattggctaggcccaaccaaaggacagagtgcaaagaagccaccagcatagcccatacaggccaacttggtgaagcacagagcaggatggagcgtggcctgtggaaggaaagtggatctggagggataaactgtaatgtccatcagagcctacttcttccaccattcagccttcatgcttgagctttctncagtgaaaaattcctctct

SEQ ID NO: 76 - DNA, 518 bp, Homo sapiens
aaaatattaatgacagatttatttggccttttaagtgcattgctaaattctcctccaatctacttctaaatctaaagcagagcctgctttagaaagagaagaggaaaatgtatttcaatttagaaaagggaagtcttttacaatattcttaattcacattatggtgaagcagtatacacaatagtaggctcccctcttcctgtgggttttaccttgaaaggggctgccagaacagaagtttcagggaaggggccagagccctggggactttcctcaggtgatggtgatggaagaagaggcaaggcaggacaggagggctcaggtaagggagactatgcaggtgcaggggcaggaggaaaaggagcagttggaggcgaaagagacaaagcctcctcaatatttctcaattcagaaaaagcatcagatatccccagtttaaatcctcaatggaggcaattttctcagtagttcttttagaaatttctaggtatcattggaagtaagtctcccatttaatt

SEQ ID NO: 77 - DNA, 267 bp, Homo sapiens
tttttttttttttttttaaaagatcacaatttatttacattagggtcatccatagtgcaccaaaactatttttggtttcccaagaaaaaatatgtatgcataaatcttcatgttaaatggccagattctaagtatataatgagggtagaatcaatgggatttttggatttgctcgcaggttggatgtgaaagggagaaaaggtgggatgtcagagtcaagaatgactccttccaaaataacctagtaagatgtctcaacatcttcat

SEQ ID NO: 78 - DNA, 574 bp, Homo sapiens
tttcttggtatcatatcttgtgttcttcctagtgaattccagactcacaaagattaaaatttgtttccagcaagaaaatgtcctttccacatggaattaaccgtgtgaagtctcttgtgttaaactgaactgggttgaaagaaggtacgccattctgctgtgcttattctttgggacacgttttccaattctcacacactgttcatctgatttactccacaagcttgctggtgatgctgctgggtcttgtgcactgggtaagtgaatgcctgggccacatttagcagtcaccagacagtacacacattccctcacatgtgaccagtcagggcagaagggctgtcaggtcgaagagctgtcacattttcagaagaattagacacccccactgcatttgtgctatgccatagtactatgctcaatgctgatggaggtgatttgttaatagcatgaagccactgccctctaacagccgtgttgggaagataagcacaaatggatcatgtaattaccagttcaagacagaaggagtgtaagtgtcaaataagtgattccaaagataaaactggacaag

SEQ ID NO: 79 - DNA, 3269 bp, Homo sapiens
tcgcctctcagccaagtccaatagcactcacttaggtgtgcatctgtggctttctctctgtctggtcagtgctcctttatatgtccataccccctgccagagggcagcattgagggtgtacagagcccagtgtgactctcctgcagctggggacatagaagagctctgtgacgatggcagatgtggttctccagcctcttgcctggctgccagtgggagtagcctgtctgttctggcacagggggctgttccatatggagggtcagaaactggccttcacagccacccaggcgttccttccacttctgcacgtcttcctttccccatgaagatttgggtgtaccctggttgtggtctctgaagactgggcaggcctgtactttgtgaagctttcagctgtctctggtaggcctgatgaagcctatctgcagaggttggcctgaagccataatgagcagttctgttctttttagcccttgtctagtttatggctctgttgcagacatgcctttctgtgtcttggttaaaagtactggtgtgtctttgcatttaggtgtggtctgtgagtctgggaaagcttctagaggagagccctccagggttgctctttggggtgggagtagtgggagcggaaatggaacgctgactgccctcttaaagccagaagggtacttcattcagggcaggcagttggcatgtgtaggcactcaggagtcttccttcagtttcagcggccggtgttcatcatcaggagtggcagggttggatatgggagtgagaatgtgcctctgagattgaccagtggccatagactccagcaagatgtgcatcttggtctgagaggcacccactgtaccagaaaccagacttgtatcgaccaatggcttattagccccaggaggcttattactgccacaaatgtccctgatggtgagcagcacttggccactactgtctgatgttaaccagagttatgggggtggtttctgcaaatacacaatactgtggaggggttatgtggcttacccagaggtgcccagatagcaaatgaaggtgtaagattggaatccctgtctttctggttgacccttggcttggctaatcattcattcattcattccacacacattgatgaatgccgactctgtactgggttctgttctaggaactagacagacacatcacctatgctgctcttgtggggcttctgttccgctgggggagacagtcagtagtaagccttcaagcaaaggcatggctgctggtgtgatgagtgccatgaagacccataaggctgcgttaaaggagatgggtggtccaggaaggcctctctgaggaggtggcatttgagcactcaagtgccttacactggacttctgaccccatgagctggaacttaggatatctgatctagaagtacctctagaagtcctcttcccaataaacaagctaaggcccagtgagcttaaggtgtgaattcatggggtgattcatgggaaagatgaaattaaacccaagaaggacaagtataatagccggccactgctctgctcacaccagccttgggctccagccctctgccttttcatcccagaatgtgttttattatcttcaagactcagccctttgaaagatttagactgccaaattgcatttattaacaataatacatttattttctcatggctgggtgtggggagggggtagaaattttaaacacatttgtgacggttgatcagccctccaggtaaggcaacggctgactgcctggagctggtgtttttcctgcctaggcggagacaccgcccaattttgtaccaccagctgccgtcactgtcagagtggaatttccattggtgtttctgaaatagcagtgtttcctggaggacccccatttgtactttctggattccatctggacctggtttagggggttagatgcttttgaatgggggctggagagaccctactgatgcctctgaccagagatggtgaggcaggactcacagggcccccagggtttattttagggagagagaagcccacagttaaatcagaggtcacaaatacagcagcagaccccacctctcccaaggaccagactgagctataattggccaataatttcatctaaaagcaggaatcctacatcaatttgaaaggagcttctggctgaagtaagactttattaattagcctgttaggaaaatagtttcccagtattatgagggctggataatttcatgcccactgtttttcttgaagcttctcaaaggcagacacagccgcgtgcagcggctcacgcctacaatctcagcacgttgggaggtcgaggcaggtggatcacgaggccaggagatcgagaccatcctggccaacatggtgaaaccccatctctacaaaaatacaaaaattaattgggcgtggtggtgggcgcctgtaatcccagctactcaggaggctgaggcaggagaatcagaggttgcagtgaaccgagattgtgccactacactccagcctggccacagagcgagactcagaaaacaagggaagacactagattttcatttttgtactaaatagaaaaagtaatatctttttaaaaatgtgttttgtttgtttttaactgtttgttcatgccaatgtgccaggcaccatatttattctttaatctatacagaaatgctgctggatgaatggaattatgctcactctgccaatgagggaaccaaggctcagaaaggttaagtaaccaacctaaggtcaggtagtactgaggagctgtgcttggatacaaaaccaggtcatccaacctggaatcttagctttgacccccaaccttctcccggcaactttgatgataatatggaaataccttagactcttgacttgactttactttctcttctctgttataaaatctgctacatttcttttcctgggaaagcgaaatagattatgccaaaagttctgatttttaaaaatgttttattgtgggccgggcgcagtggctcatgcctgtaatcccaggactttgggaggccgaggtgggtggatcatgaagtcaggagatcaagaccatcctggccaacacagtgaaaccccatgtctactaaaaatacaaaaattaactgggcttggtggtgcacgcctgtaatcccagctactcaggaggctgaggcaggagaatcccttgaacctgggaggcggaggttgtagtgagccgagattgtgccactgcactccagcctggcaacagagcaagactc

SEQ ID NO: 80 - DNA, 539 bp, Homo sapiens
tttttaaaggttagttcaagtacaaaagataagagtatttgttccagagacaggtctgggggactttggtgtctggccttaaagagaaattgtgaaggagtcattttgaaaatggtgttggtgtgtactggggcctcagccaaagagacttgggctcaggaggcagtgggtcagccaggcagatgggggctcatccgcgtgtctgtgactgggggagacagggaccctgccatcaggagggagcaggagtggcagcagtgggggccagcagtaggtgtttgttccaggttccctgagctctcctgagattcttccagactcctggaaataactgggcagaggagagccaaagccaactggctgaggtcaacccacagctgcaattcagattcacatggatgtgatcccattgaactgcaggctgagattcagtccattcacctgagacatgtgagaccccgttgtggtctgaattaagattcttcaaatttatatgttgaagcccaaccaccgtacctcagactgtgatcttatttgga

SEQ ID NO: 81 - DNA, 332 bp, Homo sapiens
aaaatttagtttaatatctgtcaagttcacttttattacaaatattacccttagatgcattttcaagcctttaaggaagagatgtggcagtggaacagatacaagaactactgagtgtgtcataaggggcggttgccaccacttcctgtgcatgtcctctgagtgacagtgaagaggatgtgtgtgggtaatggctccccgtatacctggggggctatgtcacatgcaagacagaacactgacaggaacaccccaattggagtgggtactaatgtgagccagggcgcttttatctttcttgaatgttaataaggaaagcaagctcagaggat

SEQ ID NO: 82 - DNA, 1024 bp, Homo sapiens
caatcttgttggccctccggcgatctcccgttggatgaattgctcctgctgaaactcgagtcccctttgatttgcgcttcattaattattcatgattcaggttggaaggcctgctgacgaccccctgtggccgttctctgagctttcctgtcacatcgtttccttccacgctctttggttccttatggtcctgctccttctgctgtcagaggagcagagagttgatcttattcattctggatacggatactttctagttgatctggataatcaagataacgacccacaacagcggcggagagggagcagccagttggtgtgtctcagaaaatcccactgagttccgaggcctcctagatgtggaatcctgctgagagttgttcccaggtcagagaatggagagagcctgtgcatgatgggatatccccgcctagatctttcagtgagtctctgcctcagctactcttaggatcagggggagaaccatggtgtcagacatccagaaagaagacgggatgaatgttttacctctgaggtacatcccaaatgtgggagttaacttcagctttgctggggtctatttggccagtgaaacgctgcctggttcattcgcacatccggaagccacttcacggggggccgtcgcaactggaaccacacacttggcatcggcggttgagccaaatggggactcgtggtgcaagcaacgctccccacgtgttagcgtgcgtgagatgcggttggcggaattttactaggtgcgtgttggtagagtggggctgaggttttcttgctcctgtggatgtataggaagtcaaaggtcctgcccagccctgcggtcccctcagtcaactctgtttcggagacgtaacgatttggattgccaacaagtcaagaaatgttcaagcccttggatgtagggtaaagaaagagagatcagactgtcactgtgtctatgtagaaggggaagacataagagactccattttgaaaaagacctgtagtttaaacaattgctttgctg

SEQ ID NO: 83 - DNA, 462 bp, Homo sapiens
taagggcctaaatgtttatttgagaagccacaaaagacatttaagtttctaagcaggcgatggcccaatccaagcaacactttttaaaactgtggcaggaggatgggggtgtttgggggtgagcagctggggacgggagctaagggaggaggctgtgggcagaactgggaattccatatctgctccaagccagggtggagtccaaggggaggaaaaagacgttttgctgttagatattctctgtgggcactggggtagggaggaaagggaagggggacccgttaagaccaaacaaacaggtagctgcaggacagggagagaaaagtattggagatgattcccaaactccaagcctggtgggcagcaggaggaggtgcccagcacagacacaggggagtcaggaagaagagctggctggtggagagtgaacctgtggagaccaagaagccccatcccagccta

SEQ ID NO: 84 - DNA, 3438 bp, Homo sapiens
cggttctttccggaaattatgactgcagctgttttcactccgctgtgactcagagcgctccgggctgcaggagaggaagaaatcttgcatcaccatggtgcacttctgtggcctactcaccctccaccgggagccagtgccgctgaagagtatctctgtgagcgtgaacatttacgagtttgtggctggtgtgtctgcaactttgaactacgagaatgaggagaaagttcctttggaggccttctttgtgttccccatggatgaagactctgctgtttacagctttgaggccttggtggatgggaagaaaattgtagcagaattacaagacaagatgaaggcccgcaccaactatgagaaagccatctcccagggccaccaggccttcttattggagggggacagcagctccagggatgtcttctcttgcaatgtgggtaacctccaacctgggtcgaaggcggcagtcaccctgaagtatgtgcaggagctgcctctggaagcagatggggctctgcgctttgtgctcccagctgtcctgaatcctagataccagttctctgggtcgtctaaggacagttgccttaatgtgaagactcctatagtccctgtggaggacctgccctacacactcagcatggtcgccaccatagattcccagcatggcattgagaaggtccaatccaactgccccttgagtcctaccgagtacctaggagaggacaagacttctgctcaggtttccctggctgctggacacaagtttgatcgggacgtggaactcctgatttactacaatgaggtgcatacccccagcgtggttttggagatggggatgcctaacatgaagccaggtcatttgatgggagatccatctgcaatggtgagtttctatccaaatatcccagaagatcaaccatcaaatacctgtggagagtttatctttctcatggaccgctcgggaagtatgcagagccccatgagtagccaggatacatctcagctgcgaatacaggcagccaaggaaacactgattttgctgctgaagagtttacctataggctgttatttcaacatctatggatttggctcttcctatgaggcatgctttccggagagtgtgaagtacactcagcaaacaatggaggaggctctggggagagtgaagcttatgcaggccgacctagggggcactgaaatcttggcaccactccagaacatttacaggggaccctccatcccaggccaccccctacagctttttgtctttacagatggagaagttacagacacgtttagtgtaattaaagaagttaggatcaacagacagaaacacaggtgtttctcatttggtattggagaaggcacctccaccagcctaataaaaggtattgcccgggcatcagggggcacctcagaatttatcacaggcaaagacaggatgcagtccaaggctctcaggactctgaaacgctctctgcagcctgtggtagaggatgtctctctgagctggcatttgcctcctggtctgtctgctaaaatgctttccccagaacagactgtcatctttaggggtcagagattaatcagctatgcccagctgaccgggaggatgccagcagcagagacaacaggagaagtatgcctcaaatatacactccagggcaagacttttgaggataaggtgacatttcctctacaacccaagcctgatgtcaacctcaccattcaccgccttgctgccaagtccttgctccagaccaaggacatgggcctcagggagactccagcaagtgataaaaaagatgcattgaaccttagccttgagtctggtgtcataagctccttcacagctttcattgctatcaataaggagctcaacaagccggttcaggggcctctggctcatagggacgtcccaaggccaattctgttgggtgcttctgccccattgaagataaaatgccaatcaggttttcgaaaggccttacactctgaccgtcctccttctgcatctcagcccagaggggaacttatgtgttataaggccaagacattccagatggacgattacagtctctgtgggttgataagtcacaaggaccagcacagtccaggctttggagagaatcaccttgtgcagctgatttaccaccaaaatgcaaatggttcctgggatctgaatgaagatctagccaagatcctaggtatgagtttggaagaaataatggctgcacagcctgccgagcttgtggattcctcaggctgggccaccatcctggccgtgatctggctgcacagcaatggtaaggacttgaagtgtgaatgggagcttctggaaaggaaggccgtggcctggatgcgtgcccatgcaggctccaccatgccttcggttgtgaaagctgctattactttcctgaagtcatctgtggatcctgctatctttgccttttgaagataccatccagaaaaagaagtgcctttaatttgctactgtcatttcctctagtatcacttttgctgtgatgatgtgttcttgtgtattataactctttattttttgccataaaagtaaaggatgcttactccacttcgcttctctgctccaggttcactttggatatgatctttcttttcccaacatatgccctcagaaaagtgacagtggtcccagaacctattccctttcttgagggagttcaaaacattcataggcagtaatgttcctcccagggtttccagggaaacaacatgaaaaacaggtgacatgaactacagactaaagattgcagcatttatgttagagaatgcttgaattagagaattttctgcattatctttgtctgttcactttctatcttatatacttatcagggccatactggtaagcttgcgtaggaggagttagagggaagttgaaagccaacatctggatcaatgtaatgtcaagatcacaaagacagagactgcaggggtccactgtgagaggtgacactgttggggaccttcctgattcattcttcttgggctttgctagcctgtacaacctacatgtcttttcttccactgcctgaaagacttgggttgaactataactgttggagagagatgttcctctttaatcatgaaacaccttaagaagtctataatgcaatccttagtcctaccctgaacctatgtgtcctctaagtcaggccctgatctagtgcagtaaagggaagggtgggcttaatgggagctttgcctgggacctgaacctggagcacttaccgcattaggaagaaaggagctccccgtaatcgttcctgacccttgtgtctcatataccctatcctggtggaaatgaccctatttgatatgctgtcccttaaaataacttgtatcaatattaaaatgactatttctaccctttgatgagtaaaaaaaaaaaaaaaaaaa

SEQ ID NO: 85 - DNA, 495 bp, Homo sapiens
aggacacatagaagagttaacaaatacaggctcagttcttcatcctgtacaagagttatagcaaggattaagcaagttacaacagttctcagtacacagaaagcccccggtaaatcctagctatgttttttcccatagtagaggtacagtttgggaataacaactccaaatagcatttgtatgtttgattgtttgtttgcagagatcaaagagagcaaaggaggggtaacagccagggccagccttaatgaaaccctaatgaacaagtttccacaattaaggacaataatgggacaggaaccagtggggcccagaaaacaatcaatgcctttgattaagcactgctgacgaaatttcccattggtgctttaatatggctccccgggggggttgttggctttgcaatgtcttaaggaaactcatctctttttttttatacaaataaattcttgctctgtcaaaaaaaaaaaaaaataacccggacatacagggcaa

SEQ ID NO: 86 - DNA, 207 bp, Homo sapiens
tttaatggacctcactttattccagctttattagctaatggcagctaaaagtgattttacacaaaataatgtgtcggagatcattgttcccgggcacaggtctcaaattccagcccacgaccgaaggccaaacgtgcccgttaatgattaaacctctggagtcagtgctcagggacacaggcagggagcagcaactttaatatacgc

SEQ ID NO: 87 - DNA, 1524 bp, Homo sapiens
ctactgcagtttcatatgcaaagcatgcatcagccacatccatgctatctcctaaagcagtcattctgaaacccaatctggggacagtgcagactaaataaaatttcattttgatttggcctcccgctgcgaatgggactgctttgtctcagccgacagaaccagcaagccagaaagggaatgaagacatttggagaagaagcgtttactgaaaggagattcctgggctggaggaaaaccatgatctacagttcatgttgacagatattgtatttttggtcctagatctgacttttgaaatgacttatcacaaattcaaatttagcaatcatgagtgaagtacccacgatgtgctaagcatctacctctgcagatagaagaacacttactgttcctgagcatgggagggaatagaagttcctgggtcctggcctcacctcatcaggcactgccaaatttgacacctccttcctgttcacggcagtcctttgcgatagggtattagatgccaccaagtagctgcataactcacccatttggtcagagcctgggtctaagccaggtctgacagactccaaagcaagccctgtttacagcatgactgggatccagtggacgagggaactgagctgtcaaaactaagtgacttgattgaggccatgcagctggcgaggggaggaccaggatctgaacccaactgggtctcccaagcctgggccactgaaccatttcacctcttggaaaaacttaatggtcagagtggcccacccagtccatggacagcatggaggataaactgcttccctagaaatcctctccagcattcttgccaccacgactttgggacacattgaccatgaggaggagctggtcaatgatggacaggagtccagattagcagagatgtggtaataaggacaccgatgcctaaatacttgaaatatccaataggaagcattccacctttgtgcaaatgcgaaccacatctcaccaagttcaggccaaggctgccaccggtgacgttttggaaaagaaaaaaaaaagcggggggagaggagagaaacagagaagcaaggaatgcagaagagagcagaggccacaaaaacagcagcaacgtgtcctgtgtattctgtttccttgtaaaactatgaagcatgttaaggagatacttcattttttgaggattcatactcttgtttatattataataaaaacaacccatgttctttctaaaaatttaggcaatgccttcgtgcacataaaagtaaaacaaaatcacctgtaatcctaccacacgcagatcagcacttgctaatcttttcacagggatcctaagaatatcctattctctatagaatatagttgatttatgttacctaataactaactgttaaccattttaaaattcttcagttttacattatgctagaaaaaaggagccgtcactctacgtgacatttctgtatattggtttattcattcaataaacattttttaagtacctaaaaaaaaaaaaaaaaaaaa

SEQ ID NO: 88 - DNA, 2347 bp, Homo sapiens
ggcgtgggacgtgctgcggcgtcctagctggcttacagggcggcggcggggtgtgtgtcctctgttaagagtgctactcgcccggggttgatctgtgcatgccactcctgggtcagacggtgaggtcggcgtctgcgaggacgcggcggtggagtagaagggcagccggagacaggcccggcgccccttccgaggctagacggccccagcttcgcggggatcatggcattgctggtggaccgagtgcggggccactggcgaatcgccgccgggctcctgttcaacctgctggtgtccatctgcattgtgttcctcaacaaatggatttatgtgtaccacggcttccccaacatgagcctgaccctggtgcacttcgtggtcacctggctgggcttgtatatctgccagaagctggacatctttgcccccaaaagtctgccgccctccaggctcctcctcctggccctcagcttctgtggctttgtggtcttcactaacctttctctgcagaacaacaccataggcacctatcagctggccaaggccatgaccacgccggtgatcatagccatccagaccttctgctaccagaaaaccttctccaccagaatccagctcacgctgattcctataactttaggtgtaatcctaaattcttattacgatgtgaagtttaatttccttggaatggtgtttgctgctcttggtgttttagttacatccctttatcaagtgtgggtaggagccaaacagcatgaattacaagtgaactcaatgcagctgctgtactaccaggctccgatgtcatctgccatgttgctggttgctgtgcccttctttgagccagtgtttggagaaggaggaatatttggtccctggtcagtttctgctttgcttatggtgctgctatctggagtaatagctttcatggtgaacttatcaatttattggatcattgggaacacttcacctgtcacctataacatgttcggacacttcaagttctgcattactttattcggaggatatgttttatttaaggatccactgtccattaatcaggcccttggcattttatgtacattatttggcattctcgcctatacccactttaagctcagtgaacaggaaggaagtaggagtaaactggcacaacgtccttaattgggtttttgtggagaaaagaatgttgtcccaagaagataaaaaatattgttaagtgtgcaagttattaaaaaaaaaaaattgggccaggcacggtggctcacgcctgtaatcccagcactttgggaggccaaggccagcggatcacttgaggtcaggagttcgagaccagcctgaccaacatggagaaaccctgtctcaactaataatacaaaattagccaggcgtggtggcgcatgcctgtaatcccagctactcgggaggctgaggcaggagaatcacttgaacccgggaggcggcggttgcagtgagccgagatcgtaccattgcactccagcctgggcaacaagagcgaaactccatttcaaaaaaaaaaaattggtgacagactcaatgatggaatgatttgtcggaattaacacaaagcagattttattcatataatgacttttttttaagagtctcttttttaaaaaaacttaattctctaaaaccgaaatggttcatgcttctttttaaaaatgattgtataaaatgtatggaatggttagcctggtgtggtggtgcacacctgtaatcccagctacttgggagactgagacatgagaatcgcttgagcctgggaggcggaggttgcaatgagccaagatcgtaccactgcactccagcctgggcgacagagcaagacactgtctctctctctctctccatatatatatgtgtgtgtgtgtatatatatatatatgtgtgtgtgtgtgtgtgtatacatatatacacatatatacacacacacatacatatacatgtgtatatatataccatcccatatatatgtgggatatatatatatatatatatggatatggttatatatatgggatggtttggttggtcccagcaaagtatatgaaaattaaagttctgtgataatgacaaaggaattgctgttactgtactgcaaatatgctgtgggttctcggtgttcaaactcttctaaggaaggacacacagtagctctctgcttgctgatagatggtttcccagtgtgagatttgttattttgatcagagtattcaaatcagaatttaaatctagtgtttctattttagtttagcttcctgatttatataaatgaaatctcatttataaagtataataaagatgactgtaagacaaaatccaa

SEQ ID NO: 89 - DNA, 689 bp, Homo sapiens
ttttttttttttttttatcagtccatatgttaagtatttatttattaagtaaaattctattgaagactaagaacgaagacacaaagatggctgagacacagcccttgcgatcaggttgcctacagtgtagcggaggagatgaaagaaaaatcaatcaaggttaggtgtcaaatgaaaacaggtgaagtactcaagaggcattcaccttgggaagatcagaggacatcctgcctgaactggatctccaaggctcaacagtttgtcaggtgaagaaaggagaaagagagacaaaagaactaacagatatatggaggtgtgaattcacatggcaggtaatttggactggtgaggatatgggatattaggggacacaggctggagactaatctggaaaggaaggcagcagccagttcatgcttaaagtttggaccttatcctgaaggcattatgaattcacttaaggatctttagcagacatattgtaatacaattggcttaaaaagaaaagtctgaggagctatggaggatggattggaggggacacagagagaggatccatctaggagtctgttgctctgtggttgatcaggaagatgatggggactggagtaagacaggcaatgaggcaaggaagggaggtgttcagaaatgaataaggacaggatagataatgccaggagaccagctgg

SEQ ID NO: 90 - DNA, 304 bp, Homo sapiens
  misc_feature (269)..(270): n is a, c, g, or t
  misc_feature (272)..(272): n is a, c, g, or t
ggtacatgatgaatttgttttttgagaagataacactaagtgacagggaagagggccatggggtgaaagtgggattaagagggcaattaggaaaatgtgatagcagggagacagtggcaggggaccctgtagacctgagattccgtcaacttccttacatctaaatgattatttctcctacctggggtccttggaaccaatccaaatggtgctaagctctctccttggtatgatgtagagagaaaatttcctcacttaggttctcagcnnanaaaaaaaaaaaaaaaaaaaaaaaaaacttgtc

SEQ ID NO: 91 - DNA, 59461 bp, Homo sapiens
aggcagaacggtcgccgcgtcgcctcagcacggacctccagggagctcctcagcaagatcctgccagggcgcccctcagcgcgattctgccggggtgcctctcagcgtggtcctccccggggctcctcagcacgattctcccggtgcgcccctcagcgcggtcctcctcggtgcgtcagtcatcgtggttctccccggcgcgcccctcggcgcggttctcctcggggctcctcagcgcggcgctcttctgggggctcctcggcgcagttctccccggggactcctcggcgccgttctcctcggggcacccggggcttttcggcgcggttctccccgggggttcttcggcgcggttgtccccgggggttcttcggcgcggttctctccgggggcctctcgccgcggttctgttctccccgggggctcctcagcatggttctcctccgcgcggtcctccctgggcctcctcagcgcggcactctcctgggggctcctcagcgcggcactctccccgggggctcctcagcgcggcactctcccggcggctcctcagtgcggttctcccagactctcctcagcgcggccctccccatctctctgggagggtttgaacacggtcagcacggacctgggcggacggcgcgggacgggtgatcactggcgttgctgaggtgagctgtgtgccccgcggccgtcccagatcacaggcgtcagcagtgcagcctggcctgggcagtgcgctcccatctgcaccttatggacagcgtggccagggtcgaggtccgagttcctggccgcgtcccaaggatcggattccgggtctatagttctcatggtggttcagagtgggctgaattgggattggagtctggaatccgcatcgtggttctgagtccgcgctattgggatggaagttgggaatccatgttgtggttttgagtcaaagcccgaattgggaccggagtcggaaatccacttagtggttctgagtcagggcccgaattaggatcggaggtgggaatccccgttgtggttctgagttaggtatcctagttgggatcagaattcgggtctagggtccacatcctggctgggagtttgcctgagttgggatctgagtagttggggtcccagtcagtccgggtctggagtccgcatggtggttttaggtagggcctcattagggacagaggatcgggagtctgagttggggacctgaatcccggtctggagtctgcatcatggctctgagttgagatccaagggaggtccgagttggcgactggagtcagggtctggagtctgtctttgggtagaggttctgaatggggggctctgagttaagagattgggattggggttagaggtctcagtggggtatgggagtcaggaattgaagtcgaagttctgcctctaggtggggattctgagtcaggaattagggggcgaagtaaaggttgcagtctgagttgggggtggtgatcacctgccaggtgagaggtagtggtagaagtctcttggtcatattggagatgagagttgatcagatgcaggtctcagtctgggtagtaggcttgaagggccaccactatgttcagatcccagtaccccactgtggtccctgagcaggtcaaatagccttttatataaaattgagagtaagagtgccttcccacagcactgttctggttatgaaagagaataattcatccaggtagaatagttctgtcttagattatcacaaagtataaaaactttcctgataatatccacatttgatgtgcatttaccagttctttctttactgtggtgccccttttgctagaccaaaagctcccaacgaggaactctgttttgttttctgctgcctgctctgtacccagccaagagcctgatacacagccttactcagtcagtacttgaaggaaagcaggcaggcaggattaaccagatttctatggtgtctcaaatgatccatttctgcacctgttttccagatactcagtaggagaaaaatttaaggattgagttgcttgattatgggtgtattttaatgtgtttcctaacatgctgaggagaaaagtgggtctgtttcaggatttatgctccagctagagggattttttaaaattgcgaatcagagcatgtccaaattcagatagaaagcacaagaaaactataaagaatttcccttatgaatgtagatgcagaagttccttgtacaatgctagctaactgaatccaataatatgtattaaacaacaattcttaaacaagtgggattgctcttaggaatgcaaagatgatccaatatcagaaactttatccatgtaattcacattaagaggctacaggagaaaaaccatatggttccctcaatagaggcagaaaaaaatgatgtgataaagtttaacgcctatgtgtgattttggggtagtggagtacaccacttagcaagccaggactagagaggaacttcttcaacttgatacaagttataaaccaaaacttaacttttcagtaaacttgatagagaaattaaaagtgtatcattctctttaagataaggagtaggccaaggatgtcatcctggccataccctaatacaagaaaaagaaatggggatgtgaggatcaggtaggaagtgataaaacttagtgtagctcatagggttgatggtctccataaagattctcaaacattttggtgttacgacttgttgtattcttaaaagttattgaaacccccaaagggcttttcttgatagagattctatctgttgatagttaccatcttagaagttaaaactaagaaatgtttaaagcagaactatacaagcacatattccactggggtcatggtgtgctgcctctggaaaactctttatctttgtgagaatgaaagaaaaggcaaataatgtcgagtattattatgaaaatgtttttgacctttcctgaaagggtctggggggctctctggaatccccagactacactttgaaaattactgggctacatggaaaaaaaaaattaaggaacttaacaactaaagagagatttcagatttcagagaggttttggatataagatcagtgtactcaaaacaaaaaacaaaaacaaaccacatttctttatgccaatagcaactgactaaaaaaaagcataatagagattaggacagcaatcagaatagcagcaaaatttataccagtctaggaattaacaaagacgacgacttttatggaaaaaattttaaaactctattggaggatatagagggagatctttccatatgcagagacattttattttcttgaacagggcaacttggcattagaatgacgtcaggattttccaaatctgttaagttcaacaggactccactcaaacttccagttggagggcttgagtaatttaacaaacatattctaaaatgtatgtggaagaaaaatatttgtaaatgccaactgaacttttgaaaaggagagcagaggacttctgctggcagataccagggcacacgccaacttcagcaatcagagcggtgtggtgacagaggcccagaagagagctcagaggtaactccaagtctagaggaaggggacatgtgataaaggtggcaccacatatcagtggggactgttcagaagatgatgttggaaagccagccctaaaatggaggaataggaatatggattcctaactgagcccctaggaaaagtagactccaaatggactaaatatttgaaagcaaaaggtagttgccatttgtttaataggagaaaaaatgaataatctccagggccagggtggccgtggggttcttaaacaggatccagaaagcacaaacctcaagactaaaatgtatgaacttgaatgcattaatgattatggattaaggatttctgttaaataaatccatcatggcaagggtcaagactgttttcataataatactaaggaaacaatttgcgtttttcacttttacactcatgaatgtaactttgccatgactcattacaagatatttgaaacaattaaagctgaggagggaacaacagctaaaatataccagaaagcaccacaaatcattaagaaaaaggtaggaagattgccagtttgcaggagggttaacaaacagatgaaaatttgcccaagctaatcagttatcagagaaatgtaaatgaaagcaacagctattcttcataggagaagcattagaaagtaggataaggccaagtgttggcagaaggcaaggaacaagcctccctgtgtgctgcaggtggggacggagacaggcacagacgttctgaagagctggccaacacttcttcctcaaataaaatattttatacctgtggcccagcagtttccctcctaagtaaacatgctggagcagttctcacccagaacaacgagaggctgtgtgtgtgcatgctcagggcagcatggcccataggggtgggcagttggagctggtcactgtggttaggagcaggggactagatgtacacttcacaagatagagacgcgtggaaacacagtgctgagtgacacaaatgccaaacagaaagagggcctcagtacatgactgtgtatttaaattaaaattacacaccacccagacacgcagtactagggagtgctcgtgagtgcacacacacacacacaatgatataaataaattaccctggagaagctgtttgtgtagggaggagagcaaggatagaggctagagatgaagtggaaaagcatggagaggaagagagcggtgactttatgcagacccttacagggtgacagtgtttcataggctgagggctgtgatcaactctgtgcagagtcccaaaagccaagaaccaacgaatgaatgtgcctccatgactctcctgccagataccctctagtggcttctatttctaggaaataaaattcaaattccatcaggtttttacaagatctgccctgcttacctctctgaccactgtcctccctcactgagctttggctctgccagccttcttcttctttgttaaatctgccaagtatccctcctgccccaaggccttcaccacctctgcctggcttgtcttttctggtgatcttcccttgacaattccttcttcttatttaaatctcacaggaaattttgctctgacctgccatatctgtcatccccttcagtcactcactagctgacgactacctttcgagtctctgcaaagcacaggctacgcttttctagttccttagacatctacttatttgttggctgcctatctcttccaccggaagagaggccccaagagagcatatctgtcttccgtatagggtccgcacatggtgggtgtgtcacagatttctgttgaatggtttcattcatttattgaacgaaggaagaggccaggccaggaaagtgtgcctccattttcacaactcagtgagaaagcaaatagcatgtcaaaatctgaccccttgcaaccagggtttcttagccagccacactggtaatgcttgggacaggatgtatctttgttgtgaggggctgtcatttatattgtaagatgtttagcaccctgcctggtctctacctagttgatattagtaattctcccatagtcatgatagccaaaaatatctccagacattgccatatgtcccctggggggcaccgcagatgacaaccacttccttagaacagctcttgggactgggatggtgtctctgctgtggctctttaaaggcagcaggccctggcttgcatcctgccacatctaacacctatagcctcaccacctcggtgagaaagaccctggcccaggcctggccaatcagagtaccctcttccctggtcagcagtataatttgtttggcaagcacttccagtcccacaacctatgggctgccacccagaggtttagttggaactacgtgtcagctgccgtccctcagccatctatggcatgggcacctgtggcttgaccaagttggaggtggcctagagaggccgggctgggcctgctcaccttctccagttagtgcagactgatgaatgagtggttctcagcggataccggatccaggtttgcagtacactccaggaggaggacgagtagggtttccctcagagcaggcctggatgggagggcaaggggtggcctctaatactgcctttccttccggtgcctttatcagcctgtgccatgctcctctgaactggccggccccagcatgtccaggttactggcaggagcctgtataacccagggttccagtcacaccagccaggaaggcccatgaggctggagcgcacccagtctctggctgctctgtctgcggaactaaaagcctttctcccagagcctttcctacggctgggcgaagctcttgtttgcaatttaaatgtggcctcatttatggaagaatccctgctcctccgaaaagccttgggctcaacctccctagcagcccgggcctcagccaggagaagaaatggatctaaaaggcctttctcctgctaattgtagcaattagcattagagaatggggactcgatggggggccagcgcctggcaaaacaagcttattcccagcttaggcccaggcccagctccacacactgctgcttggccagactcggcccccacccagggtctggttggcttcagggcagggagagagggcccaggcctgtgggtgctaagagcagttgtggagggtgtgcatctgagttgttaagcctggtagctgtacaggtagccctgggctatgacttgtggtcctctcagaaaagggtctgactggaacgcagagccagaccagatattcatgagtggatcacagagtgtagactgagggctatctggtgattgacagaaagtagtcttggggcaaatgactcttaaagagtaaggagccattcccctctatggctaactggatgcctttctctccccctgctccagaaaggacttcctgttccttcactgagcgtgcttgcttatgaggcttctggaaaccaggagagttcagtgggcctcattattgagcgtatgggcaggacaacctgcttgggacataggccatgctacagttgattttagccagcttgctgcatctacacagcacagtgccttcccaggcagtgaattatgtctaacaggcaggggaatgatcattgcctcatgttagggatgcagtcattcaagaaatatttgtcaaacactcagcaggtactagaccctggcccagagggagggatttgataggagcagggacctgcctaccctcccagggttagtggacaaaggggagaaagactaactaatgttgaaggaccgtttgcaccctgaggggagtgctgaggcctgggagcacagcaggtgtatagcaggaacccactggaactagcctggggtctgaaaaactcccttggggaaagtggcaggggcaggccaagggccctctggtggtagggagcctgtgagcacctgggatggaaagaagccaagcatctgaactaccagaaaggcagctgcaggattaagcaagacccacaggtctctaaactttgaaaggatgtctgtccactgagtagataattgattggaatggggcaggggatgtgagaatgccagttaggagatgcctgcagtacagagaaatggtggcctatcaggacagtggcaatagggatggagggaagcagggaacctctagaactatggatgggtgaagtaagcctggcttggtgatgggcttgaggtgatgggcaggtggtgaggaagcgggtgtatcggaaatgaccccagaacttctgacttgtgccactgaaaggatgggtgacactgaaaggacaggggccttcagtagagtgggctataaaatgatggaggctgtggagaggaggtgggggcaggtgactggaatgtgggtctggctgggttggagagacatttggggggtcagggcctcacaggtggtctggaagcccttggtgctgagggaacagcttagggaaatggtttgcatagagaaaggcactggcatttagtggccatgccagaagggaaaacctgccaaggagactgaggatagagccagaaagatggcaagaaagccaggagaactggagggatggaaaagaggacctaggggtcatggtcctggcagaggtcacattggatccagtgcttgtgattctctgattgctggcagtggatggccactggcctgcaaatggccctagtggaatgtcccctgcctgtgtggctccctgtgggctgcctctcccctggacagatggggagagaccccttccccacctggttctctgtttcacccttggaactgtggcggtaaagaggacctccccacagtacgtgcagggaacaagctaggttgactccctcagggaggcctcgtccttgctgaggtatttcataacctcaggatagagaaatccccccaactttaatgcaaagccaagcaagctgaaaaatggccttgaataggctgagatgaaaaaacaaagaggctgtcaacatcagagactcagtgggggcagggagcttcagtggactccccacagacagcagttcctgggcttctatgcccagacccagaggcctgagcccaagatgtcaggatgggtggtcactgtaagtgcagtggattgtagctcaggggtgagacatcgcctttttcttgtcagctctccttcctgattagtggctcaaacagccttccgagactcaaggggttaactgcagatcctctaactcctccacttgctaatttttaaacacagctgagctctgagcacccctcccaaggctgtgagaggccagaggccagcacagactctgcaccaggtctgcacagcctccacccctactgttgtcaggaatctgcaggcatctagaacaaaggtgcctccattatttccctcacccagcatatcctgatacctgagccaagagttcacccagagcttttgcccacttcattgatggtctggtgggcttttgttgacacatacccgtgactcccaaatgaacctttcaggttggcttaaagccgctgggacctacacatgacaaaacccagacggaaacagtggcttacactcctgtgtccctaaaggtacctgttcctaacagtgggagtgccagagcctggaagctggaagccaaggagacagggacctccctcctgctgaccccctgccaggccacatccacctaagggatttgggatcatactccatcttcaaccactgggatcaaatggaaagccctcaggaattctgagagacagcccctatacctatgtgcactgacacacatacactgacaaatacgcattctgacacatatatgaacatgcacatatgtgtgccccactccctgccaggaggtgggttctgtcccatctttgacatgttacttcttgtccttccctaggcccagtggcactttctttgtgataggtgctgagacccccccgactgggcccagtggctgttcccaggacccagtctctgctcttatcttaacccagctctagctcccaggaccccagcctttcgcagggagagagatagctcttttggtctggcacatgttccatgccaagtagtggaaacagcagctgcagggcagcctcagacttgacatcatttaatccttgtgacaatcctacagggaggaagacactacacatatgtgcagatgcagcaaggagcagctcagccacatggaatgacttgcttgaggtcaccaggcacttgacacagcagagtttagcccagtctctggagagaccagccttccacatcctgtcatgctggggagggctgcccgctttttgtccctgctcccccagttctaaccccggaagagcgattgtccctgctgtgccttcagcccagacagaagcaggctaggagaggggaggagaggcagggctggccctcggaaggctcaccttcctcaacagttctctgcttgggcaaaggtcttccaagcagccaggctctgaggctagtcactgtcatcgttgggtgaggcagcctgggagtaccagaagttggagcaggtgggaaccttccccagggatggggctggataggcaggggtgggtgctaagtggcaggccacaaccaggcacctgggagggccaagcaccacactgagaacgcagtgcttcccctcccctcctaggctgctcaggaacccatcagtctcctgtaaacaaatgagactaagtctctggcactctaggcccaggtgcaaaggacagctgcccctgcagctactcactctgccctggccctctcaggaggcttgtgacctctgcacctgctggcttgttttgttcctaaaatacccggatccttgagaatctagaagacaccactgctaacagatttccacatcattcattctgttcttcctgtgcaagcttcatgctgggacagggaccataaaacaaggtgacccaaaaccttcagcagaatgcaggtaggcagagcagaggtctctgggagtgtcattccaaggcagtgtcttcctcctcccctatgctccccatttcccaagagtgggcttcttccaccccactcaagcacctcttcccaaggctgacctaaaggcctcaagctctgcggataggggcagtcctgaggtggcattgagtcttagggttggagtgggagatatctgtgcaaaggctgataggaacgtcctccaagggctgacttcaaagcttggcctaaaccactgcatcaaagtcagcaagctgagctgtttgcacagaaaaggaggaggagcaggcccttgagccacctgtagctctccttagggtctcaggctttcacaccagggcaggccttgggccagactacccaacttccaggccggatgtgccaccggggaggaggaggtaactgcccctcaaaaccctgcagcccagggctccaggattccaacccagggacctgcaggctcccctgctctccagatcagacccctactctcagagccctaggcccagtgggtgacagcctgtgagacaggcctgtgtggggtggccctagccccacctcagcttccaacctgaccttgctgcatgacctctggcccagccctctccacctggagtgccatctctctttgtgggatgggccaggtgggctgtgtgtgggggagggcaagtatataggtgtggtataggtggaaactgccacagtaaccagcagcagctcagagccgggccacccaatttgtatgccagccccagctgggcctaggcacgtggtgtgtggaaatgaacgaagcaggcagccctatgtttaggaggcaggtccagagctcacccaggcacagcacaagatgagtgcctggcctcagtgagcgagcactggctgctatgaggctgtggtgtggaaccttgacactagggccactggcctggctgtgtgacctctacctcatcacccagagcagggcaaccagaggcagagcctcagtgtggtgttctcctgtgaaatagtgatggcacaggcaggggctggggcccagtgcctacacagaggatcagcaaaggatggcagttattgaaacctctacggggaagttccccagacacgagaggaagacccccatggaagctgtgtgtgtgacgtgcttagattttccagagtcttcattttccttgtctaaacagaggtcatggcgcctccctctcagatcaaacagccctgtatgagtggctacaacctttggtgggctcagtgcagcccctcctgcccccttgcttgggagctgtctgcagaggcctagggagctgcgtggggtctctccacctcagcctgtatccccacccccaccaggtcccctgcctgactccagcatacccaggccctagaagcaccaactccatggctgcagctgagtggagtgtgtgcctgcccaagcctagaggggtgctgacccctccctcgcacgaggagacatcaaagggaagcaggaagcagcggcctggctgacccacagcgggtgggagaagtgcagcctcacaactgctggggattttccatcccaccaggatttccgcgggacaccccaagtccagcctttgaggctcctcaggaaccagagtttggcctggagccagttggggcagaggaggggggccaggctgggtggcttaggggtgtggttaggcctgctaaggggctcctcttctcagtctccccatgatttgctggttactggcttgaaatctgggcccagacccattccaacactgaaccctgagctccctgagacctggctggcaaggacaggtcccaatttttacaggggcctgagaggaatggagaagggatctctgccccttcctttctcagtcacacctccttgacagggggtcatcagagtgggctgtggtaggtgcaccagggaagggaccatacagaggaggctggtctcaagtcctagggtgcctgggatggccctattgaaatgctgcagcagctcttgtgcaggcagggatctgtatggacagctgggtggacacaggtgcctactgacctcccagatccttcagcagagctcagccctgagtgacagcccaaggcagacctggctacctcagcctctggctcacagccctcagccagagccctgagaggcctgggatctcaaagctgcaaggtgggaggccagaggagagaagcccggagctggtagtgatgctggctgagtgaaaattgcacatttcccaacagtgtgatgctccctatccagcctgggcttttggcagacttctgtgctttgtggaggaagctggctcagattcctcccctccctgtgcagtttgtgtgtcaaggtgtacttgtcacacccaactcaggatatcttgcatcactttgtgggtccttgtcccccagagctgggactgctgagttttagccctaagctcttgctcccatcttagcaagtcagggcccagtgttgtccttgcctctgcatcaggatggtaagctgggcatgctccgcatcacggagacctgcatggacctggattgggttgcctctatcttcaggctggtcactgggcagacacaaaccagggcctctggccagaggggacagtggctctgagttacttgtgctgctctttaggggtgagcaggggctgcttgtgcatcatagtgtatcacaggggatgcacatttacaattgaaagctactggtcctgggtagaagtggggccgagtaggacttcccagccttgaacatgggtttgtcatccaactgggacccacacttgatccagcggccatgctctgtgcagcctgggcctgagggcagccacgctcatgtgaaaagtgctagtagccaagctgccattctagtcaccacagctgtccttgcaggagcacattgcccagggctgggagctgtcatttccgtgacgggagtgagactcaacactgggtgagggtgggggtatctgttgggaattatttcaaaacaattgtggaaacttggcagtggaggggctctgggcataggtatccacaatatcctagtcaggggttggggtaccctggctctgctgataagcccaagtgagcatactcctcccccagcttggaacaggtgggacgggccaggtgacactagtgtggtctgtggtctggcctcccaagccagtggcagtactggggtggcagacatttgctgtgtgctatcccaaggcctaaaggtcacacagctaggttggagcagggttttgggcaggatgagtaggcattgctgtgctctcagaaaggcgaagcaaaccccagaagcaagggggcgagacagggcaaaggcctacactttgccatcaactcaggcctactcaatgctggccctgtccttcccctgcccctgccccatcagatggtgcgagctggcggggcttagagtgagcccccctgactcttcttggtgtggagtctgaggcccagagtgtacaggcctcatccgtgtgacccagcaggaggatgggagagtgggcccagaacttggtcaggctcatccgtggagaacaagttcttccctagtctagttgtggtctgagtcctgggtgaagcaggaggcagcctgggaaacagcctcgttctagtaggaatcgcattctcaggaacgctgactgtgcagggccctttctcactgccacctgggaggatgcctgcctgctggccatttcggcggactgtcagagcaccctccctggggtcccagaccgaaggcctgaagtccacatgggacccctgaacttctggtacctgtgtgggcttgtcccctcaaccctgagtggaatggcaacagccagctgcaaccctcctagcttcctgtcatgtgctgtatggaagggccaagagctgtagtcatctgcagatcctcccactgcacctgtaggactagcgtctcctgtctggatgtgagcaacttgctggtggcctgtgagatgggagttgcactgggcttctggataagggcttctcgttcaggtgacaattctatgtgaaggagacccatggaaacacatctatcccctgcccatgtaccaggcagagatggtacctgcccatgtaccctccatgacatggctgggtccctgaaacatcagacagatcgatactctgtgtgcatgtttgtgggcaagacacagtggcacgtgtgccctggagtttggtaatgggaggactgaagtagtgcctccgtgtgtgagctgtgccagccatccccacgaagggggcattccatgcagatggggatcctctccaggcagcttcttccacacctgattagctctgaccatcagaccccccgtgccaaaagggccccttccctggaatctgtaattctcacaggctgtcccatacattttaaatccaggaaatgtgctcacccatgagacagggatggcaagaagatatgaatgaaaagcaaccagtccgtaaaattggaagccatttcactccttaccaggtacaaagataacatgctgcatggatcagggacacaaacttacctaccttatgatgtagtgaaagaatctaaaacttttgtctcagcagactccctggaggaagccaataacaggaggccttgactaggagacctcaagccttggaatgtgcccagaccagtggggagggaaggctgggaggcagtcctcccttaccccttttctcccaggcagacctaccctgggttctctccaggcccctccgcctgagcaagtgctcagttggccactagctccctgcacatccaacaagcctttctttcctgttccttcttcaaggaaggcttagcctcaaatccagggccacagacaaaggacagtcactctcctctgccagaaagtcatttatgggacatggagaaagcatcaaatatattgcttttccaacacctaacagtggaataggaggaatagaaggagaactcagccagaaagttctggagcatagtctttttgccaaaagaacacgttttcaaatgaaagaggtggtgctggggcactgaggaatcagggggatggaccccactggagcttgtctcatgctggcagcaagtcccaggcctcaaacacatacctgggccacctcaggagagagactgcagggaagaaatgagttgcaatgctccagcctaaccaactccccttttgttaatccaatcccagaaggtactgggtagggtcagttaacagacagctgcctgtctcctggcagagtctgaccaagccccagtgggcgcttctcttcctaagtcctctggtgtaccccattcttcaagggaaacggtccccttaagaatctatgtgaaagggttctgaaattgctgtaccagttaatgaattatttactctaaacaatgtcttgataaagggggaggatgaagttagctgatgttgactaaggagagacggagttgccaaggaaattcttctaaatgaaaaaaaaaaaaaagtaaaagcagtcagctggttttgtctgactatgaaacgtgtcacagagcatgcacctttggccatcttttgcatttatgatttggaagagagatgtagcagtgagtgtggggccagggaggggaatccaacaaagccattctgcaagctagtggctgggattttggggtatagagtaagagcagccagccttagaggcccatgtcatctgggctgcctcagagctaaagctaggtaaccagagggagtaaggaaaggcctgagtcccaggctaggcttttcacagttgtattgagatgggaaagtaagggatgttccttgcagcagatgcagggcccagttgtctagagcagtatttgaaatgagttggcatttcagggcagtgtttgtgatgccagtcagtaggtaggggcttctacctcttttttagaaatgtttactctgaactaagctctatgctttaacaagttatgttttaataggaaaactgtcattgatggaatcatatgtaattcctacatttttccagttacccattcctggggaaagcttagccattggacaaaccacccagagccccaggaacctgcatttgcagacagcagtggcaggcacagtggcctagtgttgagcgggggaaacctggcctctatgtgtctggttttgcaaactaaaacgccattgcccatactcaggctgacaggttctggaggtgccatggactcctgctctgtatctcacctctagttccatcacaatgcatgagctgtcagtgggagccttttaatgcagatgctaatacccattcctaatgctagcccatccccacaccctcctgagttggtgcgatatatcctgggaacaagaaaatctgaaggctcctggtcctcaggctagcaagagccttgcctgtaagaagtgggagaaggtcacctctctcaggaggcagaactaaggctgcacagcacaagggagatgtctgaatgcacagtctgggtggcagaaggactcctgtcctttcttccacacagacctgagcacctctccaggtgccaccattttctgtctgggaacatctgctatccccaagcctcagtttcctggtctacaaaactgagatggtctcttctatacaaggccccaggaggatcactgcaagtcactgcatttcatggtgcccagatttccctgcatttctagaatgtcaacagagatgagtgggctcaaggggaagagattctttatgactagagatattctggtcaactttggaccccagcttctatggacaatagcatgtggacatgagccctggggaagcagggatgactgagcctgaagaagagctctcaagccttacactctccagaccagccttgggttgcctgaaccccagcatagccttatggaacccctgccagggtcctagcacctggtttgacctgggcacaagtactcactcactcactcactcactcactcactcgtcaaacattcactgagggtccgtgacaggctccatatggattaagcactgaagataaaacactgaatagaaacagccagcctataccctcatgctccttgaatgtgatagaaggagccagccagtaaaccctttaccacaaataaacacacagttacacattaagaatgggaggggaggtatgtgattttttacagcccagtcttaagctttagaaattggctcctctgaggaagggacatttcagctaagaaccacaggataagacagtcctggcctggggaaggggagagaaggtcaggagagagcttgatatgtttaatactgaaagaatatttgatgagctgggacatctcctgcagatccacggctccctagctttgtgaccctgggccctagactcaatccctcaacccttaggagattatctataaaacaggagtgataatattcttgtgttaaaagctgctgtgaggattagtgaaatgatgtctatatttgcctggcaaacaggaagtgtaagtagtagtatcatttgaagattattcttcagcctaaacgtgtgttcattatggccggtgtgttttctccccacctagatggtagtgctgggcctcctttggagtaccttgatgtttggggagcatggatgatatgaccataacctgagaaggcagggactgtacccattctggtcctcccaggtcccagggcccccacagtgccctggtgtgtgatcagtgcccacaatactgaatagaggaacagacacatgggaagcaacggcagcctggtctttaagggtgagggagcaccttctcctgagagagggagagataggttgggggaggttgggtgggggtggggagagcgagtgagcaagcaagctagaaacttcctgaaaagggaagttactctagaaaagggtaagttccttccaggcatcatgggctggcttaacctggaccagtttgactttactaagtcccatttctcatctagggagcctgaggccattaaggttatctggtcccaaaatcccctagagctgtcacagggatccccattctttgcctttagtcaccccagccccaagagccatcctccacatggagtgagcagggagctacaaggaaaagacggtcacagttggagagagacagagaaccaggtgggctggtaggacaggaaggtatagggagaaagtgaagctctctcctggggaggcaggaatactctcctgcttccttctacccactcttcatagaacacaaacactgcaaaaatgactttttccaaaccctcttagcattcagaagtagaattgctatgtaagaattttttcataggtgcttttttggggggcatctatttaaaaaataaccacatcattagtgaaatcttccaaagtctctttttggagcccacatttcactaatgtccacatctgaggaggctttcataataaaagaacacatacctatttcacctatgatggtcagtgcaatcttgaaaacactagtaaatagtgtccatcagctttaaaaatacaaacccaaattgggtcataccaaaatgcaaggatacacacaataacctgggtgaatcttcagggaattgtgctgagtgaaaagagccgatcccaaaaaggtgatttgctatgtggttccatttatataattttcttggaatgataaagaaatgaagaataggttagtagttgtcaggggctaaggacagggtagggtgggagggaattgggggtagctataaaagggggacatgagggattcttgaagagttagaaatgtcctgtagtgagactatcaatgcaatatcctggtcagaatattgtactacagttttgcaagatgttactatcgggggagactaggtaaaggagtatgtaagatttctctgtgttgtttcttagaactgcatgagaaatgtacaattatctcaaaataaaaatttattttaaaaaatgcccaaattaaaaaaaaatcagtagtcctcctaaaaatacccagaaatgaattttagaatgtccaaaatccatacaaagatctaaaaaaatatggaaggatgttgcaatggatttgaacatgtgggtaaactgcttctatttgtggctggaaagactttttttttgaggtggggaaggcaattcttcatcagttaatctaaattgaatgaagtttcaataacaaatgccaatgggatatgaatatacacacagatagacaactttttttttttttttttttttaattaggcaagctgaggccaggtgcattggctcacgcccgtaatcccagcactttaggaggctgaggcgggcagatcacttgaggtcaggagtttgagaccagcctggccaacatggtgaaaccctgtctctaataaaaaaaaaaattagccagtcatggtggcagatgtctgtagtcccagctactagggaggctaaggcaggagaattgcttgaacccaggaggtagaggttgcagtaagccgagactgtgccactgcattcccgcctaggtgacaaagtgagactctgcctcaaaaaaaataaaaataaaaaaaaaattaggcgtgctagttctaagtttatatgaaaaaaatgcatgtcctataaaattcagaagtagcagcagtctggccccttgtgctcctctagccctcaactggcctaacaggccctagtgtgcagcagggactattttcccatcatcactgtccacagcatctggacaagaatacagagaacggctgatttaaaaaaaatctaatctgggatcctatgcatcctaaataatcttatgaggatgcacttgtattttttctgatgctgatactattcattccaactcgcctccccatcagctttgtcaggcactgtgaattgcatggtacacatgattacaatggatggaatggccatcatgaggtatagcaatacatttaagtaacactgtgtcactactataggacaggcacttttctgcatactttatattattaatttgtgtaatcctcctaacaaccctctgaggaaggtactcttatgattcccattttacaaataaagaaactgagactaagtgactcactcaaggtgtagcaggtagaaagtagtggaattaggatatgagttcagactccagaccctgttattagcccctgtctttggctatggattagtaaaggagagcacagccaagggtgggacaggcagctgtagtcctctggaccagcttcacatggatggggctgcattgttacaggtggcctaactcagacatggaaactgagtcgctgctgcccaactcatgccatgaaaccattttggcctgcacagcttataacagcactctagctctagctatgacactttatggtgttagtgggtttttttggtggttggtatggaggaggggctgggctacaagttttagattatgtttcttattgcgggtttttaaaaattcttgaattaggcctatttgctcttttgttctctattgagttagcaaattcagtttttccaagatgccctgaaagtatgatcatacatgtatacgaaatggtccttgggtccagctggcaactcctgtgcacccccgacctggattctgccttccttgaagtgagccttggaagaaacaagtgctcatgctccctgacattattagctgccacgatgaagcctcagtcccaaacaccccagcttcctgtctaactcaagagctaatcctgtgtttaaatcttaagagtgtttagatcttaggccatgccatgaattcccctggttgactgcatttgtgaaaatgagcttcccattattggctcttaagtaatggagatgagggggagtcctgctacacagataagtgcatcataaagttacataattaaaataactgagctctggcctatcaacaggcccatcagcagtccagaatagagtctagaaatggacacaaattaaatgagagtttgaaatatgataaaggtagcagttgaaattagtagagagatgatgatgtactcaaataaatagtgttggacaactggacaaatatatgggaaaccaaattggatttaattactctgtcaaaatcccgataaagcaaggatttaaatgtaaaaaatgaaataaaaaatgatagaagaaaacatggaagaatttattaaaacaatttcaggatgagaggttatttcagaatttaagataaggacctcaaaccataaaagactgacacagctgactatgtgaaattaaaaaaattctgccaccagaaaaatattatagaaaaagccaaaacacctaaggaaaatgaggataaaatattttcaatgaatatgacaaagcaagtttctacaaatcagtaagacaaggtattttacaaagtccaaagggtatgaagaaatagttcacaagaaagaaaaacaaatgattttaagcatttggaaagataaaaacctcatttccaacaaaagaaatgtaaattaaagctccagtgtaccatttctcatctatgaaatgaatgaagataaaaacctgagtatacacttggtaagggtgggggaagaaagtgcatttgtgcagtcaaagtgatgtaaatggtacagcccttatttggcagtatctatcacaacataaatgaacattttaatcctgctggaaatggggggaaagggaggatctcttaaagtaaatccactgaaaacggagaccaaaattttacaatagagatatttgattgggaagttaatttgaaaaataacagtagttaaaatattattttatctcatatgcaataacagttgttagagttacaattatgtacacgttttagaaaaaaacaaatccagaggggattttggtttgtcttttgtaaagcattatatggtaacatctgagggcatcttttatacttggcagaggatgttggcagcacttccacagagaggatcattttttgtagaagtatggcatggtttcactgcttgaccaagaggccacctgcatcaattatcatctcccctgctgtcctctgaaatgcttatctaggcatcgatcttggtttcctcttcaactgattaactaactggtctactctgcccagtctctatttgagaaatcatttgacatcattttctttaacttgatgaaatctcctattttgacaagatttacagttcctctttataagttcctctttactttgtgtgtgctttatattgtctttggttgacaagagacagccaaagaggtcagtcagcagagatacaagtagggataagatggatagggagaaacaacagtgttcaatagggagggatgtttcagggaaactaatttcataagtggtcatttcagtagtgaatatatttgaatggttaatggctgctgttttttagctgccctacatatccatcaacagaggatctgttccataaatcatggcacaatgaaactctgcagctgttaatgaaaaggagatttgctagatgtcttaatacagatccatctccagaacataccagtgtcttccttttaagtggtgcacactggggctgaacacttactaagaaatgaaagggctccccagtcaaagctgacaggtgtcattacaacatgacccctgtggtagatcccagcacaatacactggccatcactccattctcttcaaatgtcctagggttgcttcatacagcagaccatcgtacccaaagccactatgcatatgacttggttatctcctgccaggctgtagtccagttagtgctcccttggaaatactcaagaccttaatgaactatctatctgtgaatctgtgaagctacccatttcttagaggcctctttggagagctggctgttgaatacccagtatgatggtccttagccttcttagacctttcctgtaccactacctctatgccttttgccaagtccaagtgttcaccagaaatggaactgatgccagaaagactacagctaacaatctgagcagaacagtgagcatgtcctatctgggaaaagcccagcccattgggctaaatctctagctgaacacagagactatgctccttccaattatactggaagcccaaccatgagaaaacagcacttcaactacactgttcagagccatcacctgttcacacgtgtgtctgtatacatgtaaacacacattttgcaataaaaatgcttctcagatgtactgcaccataataaatcagcattgtatgtacagctcaaaaagaagtatggcatacctatggaagaagtcaaaggcaaagtgtagaaaaatacatacagtatgctaccatttgtataaaaaggagccgtatctactaagtacatgcacacacagacacacgtatatttgtttatataaaatacgtctggaaagatgcaataggaaagtgttgagtggtaacctttagggaaggaaacttgggaattagggttgggtggggagagtgttatttttcaccccttttgtactctgaattggttttaccatgtgtgtaaagactgttgtatgatttttgtagcacaacccttgaatacataaagcacgattggctccccagaaggcaggtgttggccaggcagtggatgcacggtagggcagtgtgcagccctgcatgcacgtggctggtatgccctgcgggcagcagctccccgcacacagtgctgtgagtctctggttcatgtcactctgtggagcaggggctgctccagcacaaagaggtttttgacagggaaaggcagagccagagtcagggcaggccctgggcgggctcctagagagcccaaccaccctctaataaggggtgctctccaccctatctgaggagcaattgggatctcctaggaagtgaaactgttacgtatgtcttattacagaatttccagtggagtgattctggaagaaatgtgtatggcatgttgtgactgctatgtctcatgaaatatttacgtttttatgtaacttttttccattttcagatcatcttttattttaacgcaaaatgacaatatatttttcaattaatttgcccaatatctgtgtttaaatgttttctaatgcacacacgtgttttaaactcattaaaaaaatatgacttagatcccatcccactttcatgttttatattgccaaaactctgcttttgggagaggtgagttatcttcacttctgaaacagtactgcttgggagctggtttggccctggctattctggggaaatgacacaatattgacctagaggggccctaatctttccccgctagagcactacctctaatagggtgaaggatgggagaaagaggctagtgaacccaccttcaggtctgtccactcaggacatgcccacactagcctctccaggggctctgcccttggcatccccgtcccccacctgggctctggcagagaagtcaggcgggaagaagccggctgagtgcccgccactgtaagaggaaacgaagagaaacagctccagtcagccccagaagcgaggcctggaaaaactctgcagctggagctaacacaaaggacttttcagaccctgcagccaaggtgcccagtgagcttttttttttttttttttttttttttttaaaaaacagctattagggtgacaagcctttccaaaggccagcagttggcgagagtttccaggaagctggtctggcactgggctgggattggagcaactttaacgagttaagttcagaaggaaggagtcatcaggaaaggtttaaggttcaacaaacttttcaaattattttgcaaaaagttctggctttccaattcaaaggcatgtttcgctgtgactgttttaagccagagcctatttaaaaggcaacacaactagcatgcttcagattcactcactcgaggtatttgtctaaatcctccgaatgggctttgcaagtgccatctagtgcctagtaacactggggccatcttacacatctcgacaggcagccctcctccccacgtgcctccccccagcctctgtggtcgtgtgcgcgcgggcgcgcacacacacacgcacgcatgcaccttccctaagcaggaagctgctctttgccaagagcgaatggaattcagatttccagagggtgtccttggcctccagctctacggctgcatgatgaagaaaggtcctagtgtgtgtgccgggggctgggagagaggggcctccagctctgctcacatctatctgggccccaagaaaaacccacaactggctgtgctctccccagccacacccagccttggtcacattccttcccttcctgagcccacactgggtggccccggcaaaccagcttccacacctccctccccaccggcagggagacctagcccaagcccccatggggcagccagcaagtacaaatgaggggctgcaccccaggcccaaagagccagaaagcacggagggccctccccccaccccacccccaatgctgggcatccccttgtggctgctgtcactcatggggaaagagacacactcccttgtctagcacccggtgagctgagctcccatcccttcctgtgcctgctttcaggaagtccctcttcatatccaaccttgactctcctggctgtggtgcttgtgggcctgggattgaagggccatcactgccctttgcaccagagcttcccaacataccagcaagaagggactgtaccccttcccctgtccagtctgggccttccaagccctgagattcagcaacctcaggaattaaacatttataggaaaacacctatgcagacaagggacatgagtcagggtggtcatcagcagtagcaaggtgggtaggctggtcacgtttagcttctctttagcccaagtaatagggtcttccacctgcatggccagggaggggataggctgagagcaatctttctacaggctgtcagcatcaacaagtggttgtgatgagcaggagtctgtatggcttttcaggtgttccggctcaaggaggcccaacaccaagttggaacctccaggcctggtgcctaggcagaaggtgggctaaacaaaggccaaggggagctctgctctgtcacttccctttgtttgctaatgagactgtttccaaaagctggcctggtagcctgtgggattgtttctctcaagatttcttctaggggagaaggtggctgaggctttgcagtctgcatcacccagtccccagaatctacaggggactcagcttgcctagtcacagttcggcttttggccttggctccagggcccattctgatcctcgtgcttgggtcagggatggtcagcacccctgccctgatgctgcctgctggggtctcctgctgagtaccgtgaaggcctactgtggcctgagaagccaacttcactgtcccttttggccagccctagaccctatatttgttcaagtaacacattgattcactggcttctcctttaggcaaggcctgcaggggactcagctggggttcatgattccttgccacctgtggtgggcctgcatggccagcccaaggcctcaagtgccacatactgctcccctgacagtcaggtggctagggtatgacactcaagaaaatgcccaggcagaacccagagttggggtcacttggtccagcccttctgaaggggactggttggatctgttgcggggaggagacaggccatgctggaccagcaaaaaagcatagaacttggagtctggaacctgacatctggccttggctctgccatcagctggctgtgtccactgggcaaggtcctatcatatctggtctcagtgcttccatttacccagagtccttccatcacctgacacctacagggatgctttcccaatcaaaattcaggccatgtggtttgataaggccaccttccaatgtggaagacaggctggtaatggagaggcctgggagcacagagctcctaggcactgccatggaatgtggggaccttagggaaggatatctcaattgaagctcttcagagcccctggggtggactgttctgtactctcatcccctaacccataccagcctgagctcaatcatatcagcctgtgaaggctgccccaccacactgcttctgcacccaccacaccaggcccccttgagctcccacctggagcccacacacccagctggtggggttcgtggggcagttcaaaaagaaaagcagaaaaaagcatttgagtattttggactggaaggaattcaatttaacttaacaaatcaggacatgaacctaaagaaaacactgaaaaacaagcccaactttgaaaggcccaaagagggaggattaggtgggagaagaaaggtcccctgtgggcagaagacagctgctcagtccagaccagggaccaggggaggatactgggcttgagtgcagaccgggccagggtagggagacaagcccaacatacactcgaggacttgaagtcaggggtgctagctgactttttagcccactctttctaccccagatacagagactagctgcctgaggaagcatagcggggcccacaggctggctgcctggtgctgcccacctcctctccagggcttggctccctggggcagaaggctcagacctataaccacagtggggttgcagggatttatttgggggaagaaccctgactgggtcagaatgattatgtgcatgcatgtatgtgtatgtagctccttgttctctgaaaagccttgcctaccaccctacttcccaagtaccctctattgccttgcaaagtcacccctgctctctgcctcagtttccccagcagggcaccacaggacactgctgtggcaaggtttatacttagggtgcagtgcagtctgatcttgtataaatgctcagtgccaaagacttaggagataagtcaggcagagtcaaaattaacctttgaaaaatcccttgaattggccctaaaaataatccctttctcagatctttgtgtatatcccctgctgggttgctcttctgcctgctaaagtgggagaatctctgggtgcacatccagagtaccctgggagaggcatgccaggtgttcctgtacctttttcaggatattcccagtgtcatcttcagagggagcctctgaggctgcagccacacatgggaaaagattacttatggagaagatcagaggctaaggggctggggatggtggggacatcggattttgaggtcagacctggactcctgtctacctctgtctctctaccttttatttttctttccttttctcctaacaaggccctatttctaagatggcacctcaggcctcccatgggaccaaccaggcctgacagactaactgctcagactaactgccagacttcctcctgctagccagtcactaccaaggatgtgtgcctcagatacagcccctgcccaggacacctacgttgtccctaacagggcccacatatctaaagcatgaatgcctagccaggggctctggggcaccataagaaggcatgaagctgggcctgccaatttgcatcctgggagggcaggtcagccttgtccaggcaatccaggaggcttcccagtggcccactggccagtgaggacctttgacctccttggctggtggcaccaggtttatgatgcacatagaggctgaacttgaagaattcttattgcagagggcagccacaagagccactggccagtgcccagataatatctgcagactgttccctcctgctccatgggccacagaatccctttgtcttgttactgctacactgccttcctaccaatcttcagggttcatcctggcctctgccatgcatatccaggctcccccagagattgtgtgtctgggaatgagccctggcttctgctcctatctcccagtgatactggcaagtccctatccttcttgaggcttcaatttccccttctgtgagctgggaggacaggcccactagatgctctctgagggacctaccaaggatgtgggctgtgtgtctcagccaacagcagtatctcctaaccccaacacaagaaatacacatagtaggtgtctggttaatgctcttggaatttcagcctatactaaccatctgaaagccactgagtctgaactctgctaccatatttgagattatctctccattgggcacctatgggttgcctagagacaagctaccatggtcctcttccctcgcccgtcatgtgcagggtcaaaggcaggtgagctacacagctcgccctgctcttcactctgctttaatgtgggtgcttgccttggcagatgggcccgacagtgataagaacaaatgacagatgcatactggggcacctgtgactgccatgagacacagtccactgattctgcctccaaccccctccccagagcagaatagtgagtgctaggtttccgcctgtacctccacgggaccccaacagctcctgaaccccattccgagatttgaggttgtgacttggggacctctagacttcccttccctccacctgactccagactgtcctggagcttgggactctcaggcctctaggcacatcttattaaggacagcagctgacagccatatgttgtgaccccatttgtatcccatggtaactcatgacctggcagtctcaaaagctctcaggccaaataaggaatgtccccacaggatctcccatcacaaagagacattctatgctggctaatattttcaggcatttccccgagtcaggtatgtggctggatgcctaacaccatctcctcaaggccttacactaatactgtgagatatactcccaatgtatacaagaggaaactgaggctgatagagattaggtgactgccccagtgtcctgtgggcaggatgaaatgacccaagctggccagggctccctgacagaccttgtccctggattcagcgaacatacatcaaaccattagctgacaaggaatgaatctgacaagctgttcatgaccaccacactgaaaactacagggcaaggtaaaagatatgaaagtcaacctaaataaacaagggacacatgatgccatgtttcaggagccccaaaactataaggatacccattctcccatgcccatctagaggctgctgcgcctagaggaggctttccatggcaactggcatatgtatggtgaggagaaaccctgcaaagacagcaaagccagtgatggggaaggagaagcagccagagccagcaggaccagctgtcaaaacctgttagcaaactacagtgagaaggaagcaaggtcctggccacaaagaacaacttgaatctgaccagtggcacccaatagggtccagaaacagagccacacgtagccagtgagctgattgtaaagacactgatacggcagggtagttgggagaggacgggccttcccatgccgggtgctgagctagactggatatccaagtaggggaagagtggaccttgacctcggcctcacattggacacaaaaatcaatcccagatggagtgcagatctacatgggaaaggtgagctaataaagctttagaataaaccagaatatctttatgaccttggagtagtcaaagtttcttaaataggacacaaacagccctatccagagaggaaatgtttgattaactggaccacatgaaaattaagaccttctgttcatcaaaagacaccatcaagagaggaagaaggcagcctgcagagggggaggcgatatttgcaatgtgtgtgtctgtgagagagtgtgagtgtgtgtatctctctctctgacaaatgactccagaatatctaaagatatataggaccataaataaacataaaacaggcagaagatgtaggcaatttatacagaatgatgtatctgactaaatgataacatggaaagggactcaacttcattagtcaacaggttactgcaaattaaaatcaccatttgatgctgctagacattcaccatcatggctgaaaaggaaacgacggaaaatgccaagtgttaggatgtggagcagccagaatgctgcctgtgggaatgaaaattggaatgactcctttggtagactgctgggtagtattcactaagagtaaacatatgcccacccaggaccctgcagctccacacataggcatatattccccagaaacgcaacctgatgctcaccaaaagcatgtacagaatattcttaaacagcaacctacaccagaaactgcctgctggccacaggtggtagaatggatgaatgatgtaggccatgcacacaatggagcaccagtcagcaaggagcatgagggagcactctcccttcagccccatagagaggctgccagacatcaaattgagtgagggacattggacacaaaggtgtatgagttgcatcattcccaccgcataaagttcaaatgtgggcaaagctggtccttgctgctagcagttaggcctgtggttaatctcaaggtcagtgacaggaaatgggagcctgagaggctttctgggggttctgttgcttcctccgggtgctgcacacatgggtcccagggactgaagatgcctcaagctgcgcacttgagacctgtgtactaatctgtgtgcatgcacattaccctttaactaaaagtttaacaccaccaccctataccagggtagcccaggtgagcctaattaggtggatagccctggccttcagggccgctaggcccagccccatcccactccctcacttaaggggacacggcttccagacttcctgactaggtcacctccgtgcttcagcctccagaggctctgcagttcaatctcccctttcaggtatcagcagagcacacaagagatctatatgggatgtgccccccgcccaaccccgccccgaccccctgccccaactgccagaagtgtctccatgacaatatcagtgcagttgtgaagtcctttgccctccagccacctctgtggcgtgaatgttctctctgtcacatcctccaacaccatctgcttggctgaggacctgagcagcatcatggctgggagttcacaagtggagagggctgagcctggccagagtgcactggggcagggtgatttggatggcctttcccttgcagaggaaatgagaagcctcactgctttcttctgggccatccacctagacagtgcggccctctccccatagcagcagccctaggccagccgcttcttcctcacgtgctcagacggaggaagtgaagtttggaaaggttagggggccacggggggccgccacagctgggctgatggcaggctggaagccagattgagggcatctgattcccaatcccatctctttcccactgagccattacgcctcggttttaatttaattagaagaacatttaatccccccgtgcatttcagagacgggtttgagcctggctggggctatgtggggctctgacggggatcctatgactcatgcagccctgtacagccctcccgggcgggcccccagagggcttccttggcatctcgtgcagacagaggtggtctggagctttgcagaagacaggacactggtctagaaagacaaaatggtctcatctgttcttgacaagcccctcactcatccttctggacactggttcccagaatgtcctttctgtcctttcccaccaaagtttacagggagagaaatatggtgaggagcttagacactcacagagctgcagtgcctggtaccctggggtctgtgggagtaggtcacagtggacctggatgtctccaaaatgtcccaggccaagctggtcccatcaaaagagctagccccttggtccatgaagccaaatttggggccacccttgtgacgtttgcccttatttccagacagcacagactggccctgtccttgctgacaaatgcagaattcaggagacattagtagtgatgtggatgaaagccaggccacagcggccttgctggaaaagagcaactcgaatgtcttggcgtgagattctgcagggtccaggagaaagttgaagacatggaaattctaattaacgcacacggggctgtttttgctcaaggatttgcgaagctgtcatgtcacaagaggccaggcaagcacatgcttgccagggaggtgctcacagtcacctggtgggggtctctgcagctttccctctgccttctttccaccccctctgcccagcctcgggggtcctggtcctcccccatgcccatctcaatgggccgggtgctccctgagtgtccctctggagagtgggactgagggcggtatctgttaacctcgagctggggcttgcccatctaagatgccaaaacagaagagacaggggcccttcagagaaaccacatgactgggctgggcagagccataggctgcagggcttatgggcctgtcctcttgggccgtctatctcaggtatccatgtgcaaccaatggggcagacgtgtgaattccaggccagtcctggctggcttggcagttggggatgcagtgtgagggaggatttcacaaaaatgatttcagcctcccagggttgcttggagaagctcacccaggccacacctgcacacagcccccaagttcagagccgcagatcctcaggcccctagccctgtgcctcagcactggcacaatgtgtctgcagtccttgcttcatcttaggcagggttgagtgagcagcaatcctagggcttctccatgcctggggctttgggggttctggggaggaagagaccaagagggctatacatgcccttctccctcctggcaccattcgaaaggcttagggaactggtactgagggctttgagagccaaaggaggacacagccgtacagcctaagtgtgtcctggggggtttactgagcagacgttggaaagatgaatggaaatctggtggctgcagatgggtgacaagggcattctagatggcaggttaccacacgcaaggcacagggatgcacacaggcatggcaccgtccccacccactgtcgtgccagtgacccttggtgagcagaggatagtgagtgggtcagaatcccaggaactcatcctggctcttggggtacagggctcctcttgtcatgggggtgctccccaactgcccatgcaggcctacagtctctacttcccacctttctctcagaagccctgtcatatggttctgggtgggagacacaggctcagggagtttgaggctggcagggactctcttgtgccccattcaacctaggaagacagcttctgcctgaaaggtgtgttcgaggctgagtcctggccgcccagagctggttgagggtcctgaggctgagcagtagggcccacctataggctggggtgcagcgacgccactctttatctcctgggtaccccgtgcctcagcttgtcatgactccctagcttgcatcaggcctgctcaccccccaccccacctctggctaacaggccccggaaagaggagcttcgcccagccccagggaccttcccgtaatcaaggctatagtgacctcacctctctggggccctgcgggcggggagagctcgagatggaaacaaaatgtgtctttatttatgtttttaatttgaattctggaactggcccagcatggtaatacatttaacatcagtagaatgctgaagaaaaatggaaatgttttttggtaactgcctcccacccactctgccccctgtgagaccccagcacacatccctgtccctcacacacaccagggcgtgtgcctctcttcccagttcagggtccatggggccaggctgcccacaggagcttcgctgcatccctgagcagctggagccgaatttaattatgggcatcactgggcgggctgtgcaggaggtggaggaatgcagccccaatgcgggcagaagacctgcacggcccccacacccctgccgccaggcggtttgggccctgaggaaacagggtgcccactgctgccagccttctcccccagatggagtggggcctctacccagcctgtatcccagaggagcctgggttcctaggccctgacactgtacgtgcccactctccccttcaggcctctctggagggaccgtaccctgacttctgaggatgcaggaacccagctcccctgaagcctcagccctgagtcttccctgaccagaacacaatgcctcaaggtggcccctttgcagcaacctccttgtttttccctctcccagtcccctcttcagatccctcaccccaagccccatgcctgggctccttcctgccttcccaggctggctcatatctagcagccacttttggaacagcctgctctgagagaggccttggtaagttacagggcagggacctggttgggtaatgactggagtctctgacctgcctgggcccacttatcactggaggccatgggagtgccaacctgaaaaggctgcaggatcttgcagaatggtaatgtgccagacccaaagtgggcagagagcttggggatggatgttcaggtctctcaggccctgtcatcctggagtggaacaagaaacagcccagtgtcctagatgacacagccacactggcttggggtcacccttgggcaggtgggtaacctctggctccagggagcttggcatgtgctgataccagcactggcagccctcacccccatagtggtgatttactgggcagctgcaagtttggctgtgatccacataagtgcctggtctctcaccaccttcacctgcaggggccttgcaagacccaagagttggtaaggcctggctgcccagctagatggactgtgggtgatggccctctcctcccagtaggactttttgcatgtctggatgctggtccgtgaccaagagaaccaaggtgagcgagagctccaacaggagaagcaagcagccagaaggatgagaagggacagtcccctctctgaggggacagccaagaggcaatacaggcactgccacctgtattgcacacaacatgagccactaaactaacactgatcactttggaggtccatcatatccaggacttggtacaggccttggccacagtgtaagccatcattctgccttctggtgctgacctgtacctgggcagcccatctggctaccagcctgctcacacctctgctcctgcctttttacccagccaggaggggcccagaagctcagagccctattctcagggtgtccatgactagtcacccctgctttccagtgatctgctggctcccttggagcctcttcacaccctacccaccatgaggtactgccaacctctctgtgaactgggggggcctggaaagacagtgggcaggtcctgtctgatcataattaccccttaagatagccactccttccctggaggtggcctcattctggctacccaaccctgccagttctctggttacacctgcagcccccagcaccatgggtcccgatttcctcagtgatttgcaaggccaggccttgcacctggctggctgcaaaggcaggaggcccagggcctcactacgacaaagacacacatggctcaggacaacctcctgacccccagagagtccaaagaacaaaacaccctttagaaaaatgttggtagagagaaggagagtttccacaagtgaccctcagaagggccgcgagtgtcactcacagatcttgacacaaagacatttatcaaggggaatccccaacgggttagcagccagaatgggactgtggccagaatggacttgggtgccccactgaccccgctgcacggctgtcaccgctgggcaccccagcggggagtcacatgtcgcaggggaatcacaccgtggccgggcaccggggattggcctggccatgccgtgacggcgggggaggacgggcatgcatcccaggccagctgtgcctcaggggaaggccaactggaaggcgtggaaaatcagccatttcctccacctgaaggagcccctgaggacagcagcagcaactggcagactgcacccggcatctgccccatggctttggccagggttccatggggaaatgctaaaaaacaaagtcgtctcttttttggggggcaggggagggggctgggggagagaaaaacaatctcagactctcaaagcatgaaaacaagtggaaaatgatcagtctggttttccataagtcaaaacaagaggatcatgttcccaggctcagtgggaagtgcccttgctctcctctcttgcctggtgcctccgtgttggggccaggcagacggcaagtggtgggcactaggcgagtagatagcactctggccagagagcaaggcttccccagcaccaagtctgactccttgagctccagtcccctccagcccagcccttcacgcacatgtaggcactcactgtgagatgtgggtgatgggtgtcagcagagtctccccttccaggtccaggtcctcggcgaagctgttggttctcatgaaatggggcatgctcacttccagcagtgttgggctcttccttactgaggagaaagtgtggggacagcacgttaggcctcccacccaacctgccagtgctgtggagccaggcctgtgagctcccagggccaggtgaggagtggagcttgtgcctggaagctccagccctgacaatcagttttatagttgggtgttggggtgggtgggtgtttaagatggccccaaagtgcctgacacctcagtgtctgaggagaataaaggccagtgaatcatcttcggagtggtaactgtgcctggggctgtgctcaggtgtccaagactctccccacctcaggttctgggcctcttcccatgttcacaactgacacttgggtcaagaataaaacagaggtgacaggcacaggcctggtaagggacaacagctcccaccaccatacattgtcacactcatacattgacagagtagtgggtcaggaaagatggggtgataggacctctgacccatgaggaatggcaagcctgggaggtgggggcagccacagaactccttcctcaaaacacgatgctacatcaaccagttgtacccccaatgaggcacaggagtccctccaacagctggcttcacattatgattcctgggcccacctctgcaactttgacacaggagctcaggatactgatccttatcactccccactctctgttgacactatcagtatttgctcttggcttatatttgtcttcatttaaatattttattgcaaaaggattaagtactcatctgtgagaagtggaataattcaaagattcacaatggctttcctcccccaaggtcatcagtgttaactgccaactagatccctagcccaccctctctgctcatccgagcagcagatgccaggtgggagttgcttttatgcacatgggatgtcactgtgactctgttcctgtcactctgtaacataagctcatttcatttttctctaggtatataggcatggatttaattattttagtcattacataatagtccacagtttagattggccacagctaaccattctgtatatcatggacattcaggctcttatagttttaagctgcttaattattcagactatgatgccatattcatctttattcttaaaagctgacatactggagcagggtgagagggtgtgtccttagtaattttaataaatgttgctagattgctttcccaagaagttgtagcaattcaggctcccccagctttcccacatccatgcctgaatgaagtgttgaatgaagcccgaatgaaggttgtcagcaccttttgcagggactatcaagcatggatgaaaactgaggcattgctgttatttccatctgtgttgaataccttttatgggcttggcatctgtttgggtttcctcttgcagaattgcctgttcatgtcctttgctcacttttgcttatcactttgtaggaattttctatacattacagacattaactccttgttatatgaggcatagatagcttccccagtctgttttttcacctgaattatgttgcttttatcctagaaaatgttttatgtttttaaagtgatacatcttttgctttataaaaaaggaaggttttcccacatcagcgtaatacaattctctcttaaatttattcctaatttcactatttgaatgtgttgtatgtatacatatgtatgtgtgtaaaagttttaatgcatttagtatctatgcctgataggacagatgatcaacaattagaaaatgaaaatttaaagggtactacatacaaacttactgaaaaaaaatctaaaataaaacataaaaccataaaatatcttgaagaaaacataagagaaaatctccaggaccttggatttggcagtgaattctgaaatacgaaaccaaaagtttaactcgtaagagaaaaagaatcaacaaattggactttatcaaaattaaaagcttttgctgtgcaacagacactgctaatggaatgaaaagacaaagcacagacttggaaagaatatttgcatatcacctatcaggtcaaggacttgcactcagaatatataaagaatgcttacaacttgacaataaagtgaacaatccaattttaaaaatggattataaataagcacatgaaaagatacataattaacataaatatggaaatgcaaattagaatcacaatgaaattccataaattaaaaaaaaaattcaaaacctgacaataccaaccactcttgaggatgtggaacatgtagaactctcatatgttactggtgggaatgcaaaatggcacagtgactttaggaaatagtttagcaatttcttattaagttaaacatacacataccacatgacctatcggttcctttcccacccaagtgaattgaatttttatgttcgcaaaaacctgtacataaatgtgtatagtaactctgctcataattaccaaatactggaaacaatgaagatgtccttcaacaggtgaatgcataaacaaaatgtatatattcatgcaatggaataccacccagcaataaaaagaaattaactaatgatttatgcaacaacatggatgaatctcaaatgcattttgctaagcagtgaaagaagccagatgcaaaagaatacatattataggatcccatttataggacattctagaaaaacaaaactacagggacataaaacagatcaatagctgccagtggttaggggagaagtacttgacttcaaaagactcaccccagggtatttttaggggtatggaacttctgtgaatgatactggattgtggacacatgactccagacatctgtcaaaacccacagaactgaatctcaaagagtggattttactgtatgcaaatttaaaaaattaacccggatgttggaggaccctacgatgaaaagcagactatgatgagcgtgttacaaacaaatgacatagcagtgaaaggaaaggaggaggaggagctggcatatgttgctttcaaaaacactgttttgactggacactctatggttaaagcaaaagtctgtcctaaacactctaatctagtaggtaaatttgcttcacatagggtactacgtgtacaatagggttacacaaataagtaaatgaactgtaggtaatgggagccaggtttctagctgtcagagaaaaagctataaataagttgtgggggagggggcaaggatgaactctggtcagaaatgtcagtatgaactcatggttagctttatatagatacagatatgtaaagatgtatgtgtactcaggttacatacatacatatatttcctagctctgtccactgagaggagactgaagcaatgataccctagtagccacgagcataccccgtgcctagatccaggttttctattcattctccagggagccagggctctctggatgaatggatgattctagggctagggtagggaaaataaaagatgagcctgaagtattgtcaagtgctagaaaagaaatgcttaaaaataaatgaaaaggatggcggggggcacatcaaaaggacacatgaacccaccagtggccacagcttgaacaatttgagcaacaaaataaataatattggactataactcaaaaaataaatactcccaaatccacactgataaaattaaataaacaattggaggagagggacaaatcttccttataaaggaattccaaataaaaaatgtagaaggaatgaggaaaatagaagtacatcacggtaatatttgctgcaggaaaacgatccatgaatgaatgctgaaattagttagtgaaactcagaaacttcacagtttcttccttgaaatgtattttaattgctgtggtagttttaacatatttgcagattttttttgatactctcctgcaggaggtagagttgaacccctcccttccccaccttgagtgtgggctatacttagtgactcgcttctaaagactaagctatggaaagggaaaaacagctattcacttacagtggaggagcctggccgacaccactttaaacgagtggctcaaggttaatattaccagtgataaaccatgttgatgtcatgttccacaatgaggaaagcatctcacctcactggcctccttcccctaaacctataaccctggtctagtcctgagaaaacaccagacaaatccaaactgagggacaatgacacctgactggtattcttcaaaagtgtcaagttaatgaagaacaagactgagaagcccgtcaccgatcagagatgacaataaatgtaatgatcgatcctagatgggatcttggaacagaaaaaggacattagtagttaaactggggaaatccaaataaatttataactctagcttaatagtgtaccaatgttaattttttagttttggtcaatgtaccatggttatataagatgctaacattaggggaagctggtgaaagggatgtgggtactcggtactatttttgtttctcttctgtaaataaaaaatgtgaggtaacaagagaaaacagaacctgtatacaatagcacaaaagaatattaattatctaactaagtatatgcaagaactctggagaaaattgtaaaactttagtaagagacaatgaagaagatataaatggagaaatatgccttcattccaatgactagaagactcaatactgaaaagattatctcaaaatctgaataaatctctccaaatcttaataaaaatctcaaggcttctgtgtgagaactttggcaagctgattctaactgcgacttggaagtgcaaaaagccaagaattggcaatattcttgaagaagaacaaggtgggagaacttgctgtaccaaacatcagtacttcttccaaggcagtggtcattagggcaatgtggtattgacacagggagagacaaataggccaatgggacaggattgagcattgggaaacagcccacacaaatatggaagcttgctgtgtatcagaggtggcctgcacatcctgggaagagcatggacttttcaatcaaatgttcaggagcagttggatacccacactggaaaaacattaagttggacccttaattacctcacatcatataccaaaaattcattcttgtcattctaggggattgaagacctaactatgaaaagcataactataaaggtcacatgactgaatatagaagaatatcttaatgacatcagcattaggatggttttttttaaaagaagcaataaccatgagagagaagactgagtaatttgacattagagttaagacccaatcatcaaaatacaccttaaagagtgaaaagacagtgcccacaaaatgcaaaggactcctacaaatcaataggaaaaatataaatgacttaatagaaaatgggcaatagacaaagtagcacatcacaaaagaggaatccaaaaggctgatgagcatgtggaaaggtgttgcgcctgactagcaatcagggaaatgtaaataaactcaggagctcatggcccgtgggggcgagtggcagacttccagcaggaaaccacacagacattacttagtcacagccaggagaagggctcagagtgaaagggctctgtgcccatgacatccttagagagaccagggaaggacctgtaaggcttgaagaatgtgcagatttggagacccacaggtctgggacctggcagaagcatgttactgcccccattttagagatttggggctgagattcaagtaccctaggttatataatgcagttgtcaagtgacagagctaaaacttcatccaggattcaattttttttaaaggaaggaagaaagaaaaaacatattttgatgtttgcatcacttgtatgtagaaggaacgatggagcacaggctagaacgtagagttgctttccaaacacccatgatgacaagtgcccatctccaaagcctgagggccaagggtgagccacctgacccctgaggaaggttctgtcctggtgttttaggaaattaaaatgtgcacatcagttggctgcccagagtgggtgggacctgcacctgccagagaggaatgtgtgctttttggtttaatcctgggaacggcatatggggcccctataacaaggggcagagaaggcctccacagatttgtttttccaattcaagaggagaggttattgtctgctggcttgtgtgttggagactgtggggcgtgctttctccaccacagggaggcagtgaccagagctgccacctcttccctgttttcacctgtggtcgtagccaggtcaggcatctaggagagcatggaggggagctgggggtgggtgggtggggattcagctctttccagacacactggtgctgcctctttcaggccagggcttgagggcaagtgctgtgccctaacaggtcttgcttgtcacccccacctctgaagtgggtatttcacagcctgaactcacagctgcagagaaggttgagcccatggtgtacttgaaagggcagttcatctggatatccaggctctgcaggaggtaccggagcaatgccaggtgccctttgctgaactgcctagagtggctggccctggggacaaagagcacagcatcctggtgacaatgaagtcacactttcctaagacagtcctggtttttgatgctttaattctttggctgcctttgctttgtcaaggccaggatctgggcctaaattttcagggcagaacaaaacaattttgttttctaggaaagtgggaggtctgggatggcaaaggcagcctcgggcgtggcgactaccccagctggggacgctggctgccaagtctcaccctctcaagagaacaggaatcaaactcagcacagcatcctcctttctagtcagtggtcctgctcgatagggggatttgaattttatttttttaaaaatacaggcacagaaaaaagactagaaggaaacagatccaaatgttaactttgtctttgggtgattttcatttccttccttattgtgtctgtgttttctattttgcatgatacttttccaagtcaagaaacaataatttgtggaagtctcctgtatctgtgccttgctctctggcccacgaccttgcacatcttatcctagagttgccagaatatgtccctccacctggcctggagctgcccatgaggctacatagagctctcctatcatgaaagtctttgaggctttctgttcccaagaaattctggtctcacttcctctgccttctcatcgagccccagacccctccctgcccagattaggtcagcattcaagccccaagtccagcctatgacaaagctcaaagctccagcccatctctgctgccctctgccctcaagagactctcgccagtgtctgggcccttcctagtaacttcacccaaccactcaccccctgcccttcccctcctgattgattaaaatccggcctaatctcccaggtgtaacccaagccctcttccacaagctttccagggctccggagattgccccctcccctgtacggctgcagggcttatgtgtgcctggcgctcagcacgggaaccttgccttctgcctcacccatgtctccccagggtttggcacaggcgagttccctgagccagcctacttcacaaggatgaacagaagctctccctatcctttgcaagtagaagccccctccctggccccctcaagaaatctccccctctcagtggattcaccaaagccctgcggatcctgcactgtgaaggagaagccctccccaggggcatccggacagctgcagccaggccctgcgtgacattgctgagccgcagccccacagcctgtgccagctgcccatgcccggctcatagaccctgagccagagtggccccgccaccacctgtgtctccactcagaggcgagaagtaagggacatggatggaaagtgtaaaagccattcccacaacagctgccaggaacaaggcgaggaatggagtgaaaatgtatattcacagctggcacccagttccgcttaggaaaataccttgcttgagtggacacctgttgtttttgcctgccagcagccaggcctggcttctgggaacagcttctcaaatcttccttagggggctcttcctttcccactcctagtgtgcagtgtttaggtaccctctggccatccccaaaggggtccctgtggaccttgcctcagccatcggaggtacagctgcaggtccaaggatggcttgtaccccagctgaggccaataagaacctggccttagattctggcaggaatcctggaagagatgacctcgttctgctgggcttcctgagctgttgaatgcaagctggtggccattttgccccttttagaaagtagctgcctaaggatacagccatcccatggggccaatggatagagagcaagggaaagggagaacaaaagagggaacgggaagggagaaggggagtgcaagaggggagagtgagagcaagtgagcaagatcatctcagctctggggtccagctgtgtctgaaacagctgggtccagctgtgtgagccaaaaaatgtcccttttgtgcttaagcttgtttgagttggggttccatcatttgttaccaagagagtcttcaggaatgtgcatgacaaagttgggggtgaggtgtgagcctacggacatgggcctgggggcagtcaaggttacaaaatagctaaactggtctgcactgcccccactagttttcagggcagagggcagggagaaggcttgtgggaaagaagctggcctgaggccaaggccctggccctagccctgcaacagcacagggaactcttggaaagggatttcctaaggtgggacattggctttctactgctgtgatgcaagtcctcatctccccaaaccttcagtgagcctctctccacaccctgctgtatgaggatgtttgatgcaaattatggaacatgttggatctcacattggatcaaaggtgtgcagaatagatttgcctcaagcatgacagtgatgtgacacagtcaaagatgacttccggaatcctgagaagtcccagggaggatgctgggctttccaaaacctaagtttaggatactgaggaccacaccccacaccccaaacacttctccttagaataagtatagcaagcctcagcatacacaaatctcagagtgaacggaaatgtctctgcaggcccaagggtggggtctgagtagcgggggcgctgaggaagacaggcagtgacagagccaggacagggtcaaccctgagcgtgagtgagcccaggaaacggaaagagagcaacacagccacccacacaactaaaatcgacccacccgggtctccatgctgcaggaagtcactgtctaggtctcccaagacacattttcaggggaaggttccaggcagcaagagcagccctaggaaactttaatatacaatggaatctgggttaagcactatcttctccaagagttgagctcacaggacattccccagaaacctctggagaggtggggaggaaagtttctggaggtctttggatggagaaaacaaaaaagtggccttgattttcaagacaaaattacacaggaagaaaaaaatgtttttaatctaattaagagcgatcttttcaccttcatcacaacatcgcggaaatgtgccagttcttaacttcacacaataatcaaagcaattagtgagggagaagccttggaaaccggtgcagatgttctcagaatgtttaatggggaaatgagttgcaggcctcattctcagcatccggctccaggccctggctaccaaatccagacatctgctggggccccacccccaggccccgagggcgcgggcttgagaaacacaggtcccttcccaggccacctcccagccaggccagaactggggccgagaggctccccatagcttctcaaattggagcctggacacagtcagagccaccccagaactggggggaggctcaacatcaaaattatgttaacaactgatgtcaaaagtaatcaactcagcttggctcccccactgctgctggctgcaggagggctgtgagtaggaggagagcaagcggccccagagggaccctcggctatgaccccctcagcctgaacactacttcaagaaaagatgtggtggcatctgtctggtatggtcctgtgggctccattccaatgctaatggactcttaaggggcccaggaatcaaaatggtcaacacttgaggaatttccagtaatcagagaaaacgtatagaaatgaggatgatgcttacttaggaaatggcctattacaggaaacagagggccacgtggctaatgtcagtgagctgtgggagagacagagaccccaggtggggcaggcagatcagcaaatcttggaggacctgctatgtggcaggcactggagacatggaggtaaagaacacaatatccatgttctcagggacacactcatatgcccttagcattcacgttcttcacactgacagcttcttaatgcaagcccaccagatactttcataagcactacctctgacttcaggcacttgctgagctgcacacagggcaggccaaaaggaatggaaagtgagccaccaccggggcagcactcactagtgaaagataaataccccagctctctcagccgcttgtagaactctgaggagtgttctgtgcagcttcccagctgcccaccatgaagctctttctcaataagtgaccagcacagcttaattcctgaattaagctgtgtgtgctgtgagactgacacaagacagggtgacaggaagctgtcggaacatttgagtagggaagcagcaagatccactgtacatttaaagaactcccttgagctgttatgtgaagaatggagtacaggaagcaagagtggaaatcaagagaccagtaatgaggtatggacaacaatgtaggcagagaaatggtggtggttttaaccagggagatagctggagagactaggtgtgggcaaatccagagagttgataagacatactgatagattagaaaggggtactaagaaaaaaggataatttaaaaaagactttcagccaggcttggagaaaaatagcatgctgctcctcatcccctctgactataaatcatctcactcatcctcccctaaaagcataaaatcagtaagtgcaaataaaaccacatgacccatgctgttagcagtattaggagaaagaataccttcaaattgcctgtgggtagcaaagtgagccaaattccaatagcattctagtcccctgcccagcactgcaaaactgcatacagaatcagagaagaggcttaaaatgctttgtcaaaaagtttgaaggtagttagcaacatcagcaaaaatagaggagtaagtacctctaaggagccttcttgccttcacagacatcctaagcaccaagcagcctaagccactgatgaacttgcagataccactgatgtggattatagtctaattaattgtagagacaccacacttctgcactgaaccagaaccaaagccaaagcaccctacccaaatgatactacagacgcgtgtacaggaaaagtccttactaaggctactccataaaattggaagtctctgttattccagatatgcagatatcaacttggggacacaaaaaacttggggggaaaaaaacaagaaaacatgacttgccaaaagaacacaataattctccaataatagactccaaagtaaaggaaatcttaaggaaacccaatgagatacaagagaacacaaatagacaatacaaacatatcaggaaaacaattcattatctaaatgggaaatccagcagagttagatatgaaaaagaaccaaacaaaaatcctggaggtgataaattaaatgaatgaaataaaaaatacaattgaaagcttcaaaagccggctaagtcaagcagaagaaataatttctaaatttgaagacaggtgttttgcaataaaccagacagatttaaaaaataacaataaaaaagaatgaagaatgcctgcgtgacatatgagacactattaagctaacaatatttcacattttgggagttccagaagaagtgttgggataaggaccagaaaatctatttaagaagataatacctgaaaactgccaaagtttgggagagaaagagactaacagataaaggaagctcacaaatccctaaatagattcaaccctaaaagggcctctctgaggcacattttcatcaaactgtcaaaaatcaaagagagaatttaaaaaacaagagagaagcatgaagtcacatataagggaatcaacagcagattaacagatttttcagcagaaaccttctaggccaggaaagaattgaatgccatattaaaagtgctgcaaggtggggaaaagctcacaaaattgctagccacaaatactatacccagcaaagctatccttcagaaatgaagcagaatgagggaagaaattttgcctccctcagacaagcaaaaactgagggaattcattactactaaatcagccccacaagaaatgcttaagggagtactacatctggaagtaggaggatgatatctaccatcatgaaactacaaaagcataaaacactagtagagcagatacacaaatgagaaaggaaaaggaataaaagattatcactacagaaaaccaaaaaattgcaaagaaaaacaatgagaggaaacaaaagtatacaaatcagtcagaaaacaataaaatgacaggagtaagtcctcacctattgataacaatcttgaatgtaggtaatttaaatttcccaaatgaaagatagatactggctaaatgaattaaaaaaataaaacccaattacatgctgcctataagaaactgacttcacctgtaaagacacccatagactgtaagggaatggatagaaaaagatattccacacaaacagacaccaaaagcatgcaggagtagacagacaaaaaatactgagtcaaaaaaaaaaaaaaaaaaaaaaagaaaaagaaaaaagagacaaaggaggtcattatataattataaatggatcaattcagcaagaagatataacaattatatatgcaaccaacaacactggagtacccaggtatattaaacaaatattattagtgctaaagagatagaccccaatacaataatagttagggatggcaacatttcatactcagcattggacaattcatttggatggaaaaatatcaacaaggaaatattagatttgaactgctgcttcgttagcacacagcacattctccaggatataccatatgttaggacacaaaacgggtctcaataaatttttaaaagtcaaaatcttatcaagtatcttctcagaccacaatggaataaaactggaaatcaataacaagaggaacttctgaaattgaacagatacacggaaatcaaactacatgttcctgaatgaccactgtgtctatgaagaaattgattttaaaaatttaaaaattctttgaaacaaatgaaaatagaaacacagcatacaaaaatgtatagggtacaacaaaagaagtgctatgagggacatttatttcaataaacacccacatcaataaggtagaaagtttttaaacaaataacctaataaacgcatctcaaggaactagaaaagcaagaacaaatcaaacctaaaattagaaggaaataaatagtaaagatcagagcagatctaaatgaaatagagataaaaggtaaaaaagacaaaagatcaatgaaatgaggcctcccccccaccccccgagacacggtctcactctgtcacccaggctagagcgcagtggtgtgatcttggctcactgtaacctctgcttcctgggctcaagcaatcctcctgcctcagcttctgagtagatgtgcagcaccacacctcgctaatttttttttttttttttggtagagatgggggtttgccatgttgctcaggctggtctcaaactcctggactcaagcgatcggcctgccttggccttccaaagtactgggtttacaggtgtgagccaacaaacccagccaaaaaactgattttttgaaaagagaaaatcaataaaccattagctagactaaccaagaagacccaataaataaaatcagaaatgaaaaaggagacttacaatggacaccacagaaatacaaaagattattagagaccattatgaacaactatatgtcaacaattagaaaacctagaggaaagagataaattcctggacatatataacctcccaagattgaaccaggaagaaaaaaaatctgaacagagcaataacaaggaatgagattgtatcagtaataaagtctcccagtaaagaaaacctcaggattgcacgggttttctactgaattctaccaaacctttaaagaactaacatgaattcttctcagacaattccaaaagactgaagagaaaggaattctccctaactcattctgtgaggcaagcagtatcttgataccaaaaccagataaggacacaataacagcaaaaaagaaaactacaggccaatctccctgatgaacatagatgcagaatcctcagaaacaaaacacacacacagacacacaaactagcaatctgaatccaatcgcacatcaaaaagataatacaccataatcaagtgggatttatcccagggattcaaggatggttcaacatatacaaatcaataaatgtgatacatcacattaacagaaggaaggacaaaaaaatacatgatcatctcaatagatgcagaaaaagcatctgataaaattcaaaatctcttcatgataaaaaaaaaagctcatcacataatgtctagaaggaacataactcaatgaaggtcatatatgacaaacccacagccacctggggaaaagctaaacaccttctctcttagaactagaacaagacaaggatgcccactttcactattcttattcagcagagtaagaaaagtcctcaccagaacaattaggcaagtaaaagaaaaagggtatccaaattggaaaagagaatgtcatattgtcctttgcagatggcataatcttatacatagaaaaacctaaagattccaccaaaatcttttagaactggtaaaggaattcaataaagttgcaggataaaaaaatcaacaaacaaaaattagtaggtgtggacatgatggctcatgcttgtaatttcagcactttgaaaggatgaggcgggtggattgcttgagcccaggagtttgagactgtcctgggcaacatggcaaaacctcatcagtacaaaaatgagctgggcgtggtggcctgcacctgaagttcagctactcaggaggctgagatgggaggatcacttgaacctcggaggtgaaggttgcagtgagcagaaattgcaccattgcaccccagcctgggcaacagagtgagaccctgtctgcactcccctgcctcccccaaaaaatcagtagcatttctgtgaaacagcaaattagccaaaagagaaatgaagaaagcaatcccatttgcaatagctacaaaaaaaagcaaagcttaaccaaggaggtgaaagatttccacaatgaaaactataaaatactgataacagtaattgaagaggctacaaaattttttgagacatcccatgctcatggattgaaagaaaaatgttaaaatgatcatatttacctatagcaatatacagatgctatgaaatccctatccagatatcagcaggggcttcaagatggctgactagaggcatctggcactcacctcctccacaaaatatagcaagtaggtaaccacagtttatatagatcgcctctgagagaatgctggaattcaactgagaagtaataagaaaaacccaatgcaagggataagaggggagtcaggcagtctgcttctatgggactggctgggatcatgaagagactcctcgatgtgcagaaaggtaagtaagtgagcccctagtggtccacattcccacagcagactcctgaaatcctagtcagagaaccccctgacccatagatgccttgagactaacaagaggctacctacagactgtgaaatggcaatgaacagctcccagagagggagatcaccctgaatcctcaggcaattcacacatcccctgaatcctcaggcaacttcaggaaagtcccattttgatagcccaacccccaccagactgcatctgctgtgggccccacatccctctatctcatccctggagccccatggacatcccttacacaaagctggttgccactcctgactgctccctccaggccaaagcatgagccattggcaatactctgctacctccgaagcaaggctgccatgaggaaaggtgaccctgcccatagtcaccacctggggccgaagcatgcattgcccaactgcctgtttatagctgctgccactgaaagcaatcccactcaacttccccaggagtagggctgcaatagagttgctgctgccccaacatgagcattcagcagggtatacagggatcttcctgtgcctgcctaccacagtcagtacattcttgcattactggagggcctcaggacaggcccacctggcctggtcccaccctcttttctcccagtgccagcgcataccatctctgggcctagggatcaccctgccctatccagtattgttggcacctgagcactcctgggggcttgaggactgccctacccaactgaccattaccaccacaactggcattcacttgaatttgccacctgtgggccttgggacaagctcatccagcttatcccagccatcccaataccagcatggacaccttgggaggcagaagattgttctgccactgctactgccattgcccaagccatatctgctgctcagagctcaaggacctacccaccctgtggcccagctctgtcatcattggcacctgagcaagttgcctggaggcccaaaattggtttccctggacttgctaacactggtaccagcatacactaccattgggcccaaggataagcattcggggccagccactgctgccactggggcctgaggactggcccagctggtgtccctatccccagccagactttaccacagcctccaccaacaactgcatcctaaactacagaggaactcccagacactactggtgctgtttacagctgaaaaaaattccatggagatcacactactgcaggcacccagaatcaaaaccaaagtgccctgcccaaagaacaccatagatatatcttcaggaacaagactctcttaggaaagacagatcaaaaaattggaagaaactactgttacaccagatgtgcagataccagtgtaagcacacaagaaacatgaaaaggcaaaacatgacaactcctaaggaatgcaataattctccaacagattccagtgaaaaagaaattgatgaaaccttgaaaaattcaatataatattaaagaagatctgatagactatacaaagaaatcagaaaaaacaattcggggtatgaatgagaaatttgcccaagagatagatataaaaagaaccaaacagatattctggaattgaataatagattgaatgaaataaaaaacatatttgaaagcttcaataacagaccacaacaagcagaagaaagaatttcacaccttgaagataagtcttttgaaatgactcagacaaaaatatagaaaaaatagaaaagaatgaacaaaggctatgtgactataggatgccataaggtgacaccttcagtgtcccagaaggtgaagagcaaaccaaaagattataaaacctatttaatgaaataatacctgaacacttcccaatctcccaagagatttagatccaaatataggaatctcagaaccctaaatagatacaattcagaaaggtcttttccacagcacattatagcaaattgcccatcccaagacaaagagagaatcataaaaccagcgataaaagaggttgtagacacttacaagggaacaacctgcagactaacagatttttcagcagaaactttacaggccaggaggatgggattatatacgcagagtgctgaaagaaaaaacaaaaccaaaaacctgccagccaggaatactgtacttagcaaagttatattcgtcagaaatgaaggagaaataaagtatttcccttaaaagtaaaagctcagggaattaattgccactacactggcactacaaaaaatgcttaagggagtcttacaggaagaagtgaaaggacaacttcatgaaagcacacaaaataatcagaaatcaattaatgacaggaataagccctcacatatcaacaataaccttgcatataaatagattaaactttctacttaaaagacagactggctgaatggacttaaaaacatgacccatctaaatgctatctacaagaaacgcatctcacctgtaaagacacatagttgaaagaaaggaatgggaaaagatattacatgcaaaaggaaacaaaaaccaaacaggagtagctatactttcatcagataaaacaaaggttaagctaaaaacactaaaaagagacgaagtcattatatagtgacagagggatcaattgaccaagaggatataacaattctaaacatatatgcacccaacaccaaagcacccagatatataaggcaaacatcaaatctgaagggaaaggtagacttcaacacaataatcttgggaacttcaattctccatttccagtattagacagatcatctagacaaaaaattaacaaagaaacattggatttaaactgcactttataccaaatggacctaacagacatttacagaccagttcataaaacagctgcagaatatacactcttctcatcagtacatggaacactctccaggatacattatatgttaggacactaagtatgattttaaatatatatatattttaaattggattcatatcacatatcttctcagaccacaatagcataaaactataaataaataagaggagcattcaaaactgtataaataaatggaaattaacatgttcctgaatgaccaatgggtcaaagaagaaattaaggcagaaataaaaaatttactgaaacaagtgaaaatagaagcacaacattctgaaacttaagggatactgcaaaagcaatgctaagaggaaagtttattgtaataaatgcctccattaaaaaaggtagaaaagatcttaaataatctaatgatacacctgaaggaaccagaaaagcaagaacaaaccatactaaacataaaattagtagaaggaaagaaataacgaagatcagagcagaactaaacaagaaactaaataaatataaaggatcaatgaaatgcaaaatcggtttttgaaaagaaacaaaataaccagtggctaaactatccaagaagaaaagagagaagacctacatgaataaaatcaaaaatgaaaaaggggatattacaactcataccatgaaatacaaaaatcaaaactcttcagtctgatcaataaattgattacagttacaggatttaaaaatcaggcttatttctatataccaataaagaaccagctgagaaagaaatcaagaaggcattatcttttacaaccactacaaaaaatctaggaatgagtttaaccaaagaggtgagaaacctctaacaaggaaaactacaaaagtctgatgaaagaaattgaaaagaacacacaaaaaacatcccattctcatggattgggagaattaacaaaattaaaatgaccatactacccaaagcaatctacagattcaatgcagtctctctcaaaataccaatgccatttttcatggaaatagaaaaaatcctaaaattcagatggaaccaaaaaagagctggaatagccacagcaattctgagcaaaaataacaaagttggatgcatcacactgcctgatttaaaaatataaggctatagcattaaaagcagcatggtattggaataaaaactgatagaccaatggaacagagtagaacctggaagtaaatccatgtatttacagccaactgatttttgacaaagatgccaagaacatacactgggaaaagagcaccctcttcacttaatggagctgggaaaataagatatccatgtgaaaaatgaaaccgtttctatctcttgctatactaaaatcaactcaagatgggttaaagacttaaacatgaggcatgaaactataacatcactattaatgaaggagacattggggaaacactttaggacattggtctagggaaagattttatggataagacctcaaaaacacagacaaaaacaaaaatagacaaatgggactatattaaatgataaagcttgtacacaacaagggaaacaatcaccagagtgaagagacagcctgttgaatgggagaaaatatttgcaaactactcatctgacaaggtactaataccagaatatactaggaactccaataactcaatagtaaacaacaaattaattccaataaaaagtgagcaaaagacatggatagatatttctcaaaagaaaacatacaagtagccaacaggtatatttaaaaaaaaaagcccaacatcagtaattataagggaaatgcaagccaaaaccatagtgagaatggctattttaaaaagacaaaaattaaccaatgctggagaggatgtggagggaactcttatacactgttggtgggaatgtaaattaatactatagaaaacagtttgatttctgaaaaacctaaaaagagaaatatgacataatccagcaatctcactactggatatttatctaaaggaaaagatatcagtatactaaaaatgtacctgcatccccgtgtttattgcagcactattcacaacagcaaagatatggactcaggaacctaagtgtacatcagtggataaatggaaaaagaaaatgaggtaaatatatacaatggaatactaattgaccaaagaagaatgaaatcatgtcctttgcagcaacatgaatggagctggaggtcattattttaagccaggcacagaaagataattatcttatgttattatcatatgtgggagctataaaagttgatctcatggaggtagagagtagaaggatagataccaaaggctgtgaaaggtatgtctggagggtgaagagaggttggttagtgggtaaaaatacacagctagttagaataaataatttataatgtttgataagagttggttgactatatttaacaatataatgtatatttcaaaataaaaaagaggacttgaaatgttcctaactatagagatgataaattgagggtgatggataccctgacttgatcattacacattcgatgcatgtaacaatagcacatgtaccccataagtattatgtatcggtcaaaaaaaaaaaaaaaaggaaatcccagtgctttggggggcc

SEQ ID NO: 92 - DNA, 7861 bp, Homo sapiens
gtttggggcatctccgcggtccggcccggggccccgggatctcggctgtccttcctcccggcataagatgcacatttttctgctctggagccgggaatgaaatattcttgagttcttacaactttatgacgagacccatgtgtggtgctattgagaaattcattgggaagttggaagacatttcaaacaacaggttgttttggtttctatagtacaattggggtggcattctgttttgtgaaaggaggaaggacttaggccagaaaactcatatgctatggttaactggttcccagcctccgagaatcttgttttccatggtgtaaaacttactcagcatcaggataagggataacgactctatggatatacagaatccttcaccatggtaaaactcgcaaacccgctttatactgagtggattttggaggccatcaaaaaagtgaaaaagcagaaacagcgtccttcagaagaaaggatatgcaatgctgtgtcttcatcccatggcttggatcgtaaaactgttttagaacaattggagttgagtgttaaagatggaacaattttaaaagtctcaaataaaggactcaattcctataaagatcctgataatcctgggcgaatagcacttcctaagcctcggaaccatggaaaattggataataaacaaaatgtggattggaataaactgataaagcgggcagttgagggcttggcagagtctggtggctcaactttgaaaagcattgaacgttttttgaaaggtcagaaggatgtgtctgcattattcggaggcagtgctgcctctggctttcaccagcagttacgattggctatcaaacgtgccattggccacggcagactccttaaagatggacctctttatcggctcaacactaaagcaaccaacgtggatgggaaagagagttgtgagtctctttcctgtttacctccagtgtcccttcttccacatgaaaaggataagccggttgctgaaccaatccccatctgtagtttctgtcttggtacaaaagaacaaaaccgagaaaagaagccagaggaactcatctcctgtgccgactgtggcaacagtggccatccatcctgtttaaagttttcccctgaactaacggttcgagtgaaggccttacggtggcagtgcatcgagtgtaaaacatgcagctcctgtcgagatcaaggcaaaaatgcggataacatgctcttttgtgattcatgtgaccgaggttttcacatggagtgttgtgatccgccactcacccgtatgccaaaaggcatgtggatatgtcaaatatgtcgacctaggaaaaaaggacgaaaacttctacaaaagaaggcagcacagataaaacggcgctatactaatccaataggacgtccaaaaaacaggttaaagaaacaaaacacggtatcaaaaggtcccttcagcaaagttcgaactggccctggaaggggtaggaaacgaaaaatcactctttccagccaatcagcatcatcatcatcagaagaaggatatttagagcggatagatggcttggacttctgcagagatagcaatgtctccttgaggttcaacaagaaaaccaaagggctcattgatggccttaccaaattttttaccccttcccctgatgggcggaaagctcggggggaagtggtggactactctgagcaatatcgaatcagaaagaggggcaacaggaaatcaagcacttcagattggcccacagacaatcaggatggctgggatggcaaacaagaaaatgaggagcgactttttgggagccaggaaatcatgactgagaaagatatggaattatttcgtgatatccaagaacaagcactgcagaaagttggagtgactggtccccctgatccacaagtccgctgtccctctgtcattgagtttgggaagtatgaaattcacacctggtactcctccccatatcctcaagaatactcaaggctgcccaaattgtatctttgtgaattttgtctaaaatatatgaaaagtagaactattctgcagcagcacatgaagaaatgtggttggttccatcctcctgccaatgagatttacagaaagaataatatttctgtctttgaggttgatgggaatgtgagtaccatttattgtcaaaacctgtgtcttttggcaaagttgtttcttgaccacaaaaccctctattacgatgtggagccatttcttttttatgtactaacacagaatgatgtcaagggctgccaccttgttggctacttttctaaggaaaagcactgccaacagaagtacaatgtttcctgtataatgattcttcctcaataccagcgtaagggctatggcaggtttctcatcgatttcagttatttgttatcaaagcgtgaaggccaagcagggtctccagagaaaccgttatctgatctgggtcgtctttcctacatggcatattggaaaagtgtaatattggagtgcctttatcaccaaaatgacaagcagatcagcattaagaagttaagcaagttgactggaatctgccctcaagacatcacttccacactccaccacctacgaatgctggacttccgtagtgaccaatttgtgattatccgccgggaaaaacttatccaggatcacatggcaaagcttcagctgaatttgcgacctgtagatgtagatccagaatgtttgcgctggactccagtcatagtgtccaactctgtggtctcagaggaggaagaagaggaggctgaggaaggagaaaacgaagagccacagtgccaggaaagagaattagagatcagtgtgggaaagtctgtgtctcatgagaacaaagaacaagattcttattcagtagaaagtgaaaagaaaccagaagttatggctccagtcagttctacacgtttgagcaaacaagtccttcctcatgatagtcttcctgcaaatagccagccatctcggaggggccgctgggggaggaagaacagaaaaacccaggaacgttttggtgataaagattctaaactgctcttggaagagacgtcttcagctcctcaggaacaatatggagaatgtggggagaaatcagaagccacccaggaacaatacactgaaagtgaagaacagctggtggcttctgaggagcagccaagccaggacgggaaacctgaccttcccaagagaagactcagtgagggggttgagccctggcgaggacagctcaagaaaagccctgaggctctgaagtgcagattaacagaaggaagtgagaggctgccccgtcgctacagtgagggtgacagggctgtcctcaggggcttcagtgagagcagcgaggaggaggaggagccggaaagccctcggtcaagctcgccaccaattctcacaaagcccacgctgaagcgaaagaaaccatttctccaccgaaggaggagagtccgaaagcgcaaacaccacaatagcagtgtagtcacagaaactatttctgagaccactgaagtgttagatgaaccttttgaagattctgactccgagaggccaatgccaagattagaacccacatttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgacactcctatcttaaagccagtatctcttttgcgaaaacgtgatgtgaagaattctcctcttgagccagatacatccacacctttgaaaaagaaaaagggatggcccaaaggcaagagccgcaaaccaatccactggaagaaaagacctggtcgaaaaccaggatttaagttgagtcgggaaatcatgccagtttctactcaagcatgcgtcattgagcccatcgtttccattcctaaagctggacgtaaacccaagatccaggagagtgaagaaactgttgagccaaaagaagacatgcccctacccgaggagaggaaggaggaggaggagatgcaagcagaggcagaagaggctgaagagggtgaggaagaggatgcagccagcagtgaagtcccagcagcctctccagcagacagcagcaatagtcctgagaccgaaaccaaggagcctgaggtggaggaggaagaagagaagccccgtgtctcagaggagcagaggcagtcagaggaggagcagcaggaattagaggagccagagccagaggaggaggaagatgcagctgcagagactgcccagaatgacgaccacgacgctgatgatgaggatgatggccacctggagtccacaaagaaaaaggagctagaggaacagcccacgagggaagatgtcaaggaggagcctggtgttcaagagtcttttttagatgctaatatgcagaagagtagggaaaagataaaggataaagaggaaaccgagctggattccgaagaggagcagccttcccatgacacgtccgtggtgtcagagcagatggctgggtctgaggacgaccacgaagaagactcccacactaaggaagagttaatcgaattaaaagaggaggaagagattcctcatagtgagctggatctggaaactgtacaggcagtgcagtctttgactcaagaagaaagcagtgagcatgagggcgcctaccaggactgtgaggaaactcttgcggcgtgtcagaccctgcagagttacacccaggctgacgaggaccctcagatgtccatggttgaagactgtcatgcgtcagaacataatagccctatctcctccgttcagtctcaccccagccagtcagtccgttcggtcagcagtcccaacgtgcctgcccttgagagtggctacacccagatcagcccagaacaaggatccctgtccgcaccctctatgcagaacatggagaccagccccatgatggatgtgccttccgtatcagaccactctcagcaggtggtggacagcggcttcagtgacctgggcagcattgagagcaccactgaaaactatgagaacccaagcagttacgactccacgatgggcggcagcatctgtgggaacagctcttcccagagcagctgctcctacggtgggctgtcgtcctccagcagcctcacccagagcagctgtgtggtcactcagcagatggccagcatgggcagcagctgcagcatgatgcagcagagcagcgtccagcctgctgccaactgcagcatcaagtcacctcagagctgcgtggtggagaggcctcccagtaaccagcagcagcagccgccaccaccgcctccacagcagccacagccgccgccgccacaaccacaaccagcaccacagcctccaccaccccagcagcagccgcaacagcagccgcagcctcagccccagcagcctccacccccaccccctccccagcagcagcccccgctgtcacagtgtagtatgaataacagtttcaccccagctcctatgatcatggagataccagaatctggaagcactgggaacataagtatctatgagaggattccaggggattttggtgccggcagctactctcaaccatcagccaccttcagcctagccaagctgcagcagctgaccaacaccattatggaccctcatgccatgccttatagccattctcctgctgtgacttcctatgcaaccagtgtttctctgtccaatacaggactggctcagctggctccatctcatcccttagctgggactcctcaagcacaagccaccatgacgccacccccaaacttggcatccactaccatgaacctcacatctcctctgcttcagtgcaacatgtctgccaccaacattggcattcctcacacgcagagattgcaagggcaaatgccagtgaaggggcacatttccatccgctccaagtctgcgccactgccctctgcggctgctcaccagcagcagctgtatggccgtagcccatcggcagttgccatgcaggctggccctcgcgcactggctgttcagcgtggcatgaacatgggggttaatctgatgcctactcccgcctataatgtcaattccatgaatatgaacaccttgaatgccatgaacagctatcgaatgacacagcccatgatgaacagcagttaccatagtaaccctgcctacatgaaccagacagcacagtatcctatgcagatgcagatgggaatgatggggagccaggcctatacccagcagcctatgcagcctaaccctcatgggaacatgatgtacacaggcccctcccatcacagctacatgaacgctgctggcgtgcccaagcagtcactcaacggaccttacatgagaagatgagcaagatgaacttgcaatcaaaaacttaaatatatataaataaaggaaccttttatactgacaaaccagagaaaaatggacctttttccagttaaaatattgctgtagatttagaggaatttttctttggtttattttattttttagaaaacctgatcttctcttttttttgggttcattttgttgtgggttttggttttcttcacaatcttgaacattttacagtagaactcatctaaaaatggatttggggatggggaaacatgcacaaaatcttttcataattaaaaagagccttactttctttacataccacatggacagaatttgtgtaaaagtgaattatctttattttaaaatgtatgtttcccctcactgtttgcagctcccaatgttgtcatttttaaatgttatatacatctcaagggttaaccagaccctttcctccaaacccaacctttcatttcctacttcattccagcaggaggcacttaggggagactcggatggggacatggagaacaacccaagctccttaaacttattattattgttaatattattattattattattaataaagtgaggcaggaaaatgcttctccttttaaaatcccctccactcctcacacacacacacctcttgaaacccttccccaagaatgtttctttatagacggacttcattgaaatctttgttgttcttgaatcaagtgtaatataatttttttcttcttttttaaaatattcccactcagcactcagagacacaaaaatactgtaagtctcaattaacagcagaatctcagagaaaagctgtttgcaatccaaatccagcctttggaggaatagagatggtcaattaacaatcaaaaagaggagattaacctcttgtttttttaccacctggtgaatcagccataacgcacacacacgccacccagcctcttgtttctagtatgtactttgaaatgctaactgagggtcttgatgcttgagcctttgactgataaaactcaaatagcagtccccagtgatttgcctcttaggttctttcttaaattgttggtggatgactgtacattttagtgatttgaaaaataactgacaaaccattgaaacagtttattttatgttggaagagatggcgcagatgtgtgtcagaagggagatcacggtgtgagtttcgtagctatttaagtgatacatacctctagtttttgtatgtcttttgagatcctgagttcatcccctgtgaatcagagtgcacaagcacctctcctgtgagtggctaatgagaagagggacagaccgaccaccagcacagtagggcagatctggacagcagaatgttataacgcaagttcatgtgttgctcccaactccattctcttttctctcgtgcaaccagtttgcccattctcttcctattacttgctccagggataggtaaaaaaaaaa

SEQ ID NO: 93 - DNA, 2913 bp, Homo sapiens
ggagatggctaacagctagagcaggctgtcctcggagggagacattccatctccagacacccagagacgctccagaatggaggtcctgagggagaaggtggaggaggaggaggaggccgagcgggaggaggcggccgagtgggctgaatgggcgaggatggagaaaatgatgaggccagttgaggtgcggaaggaggaaatcaccttaaagcaggagacgctcagagacctggagaagaagctgtcagagatccagatcactgtctcagcggagctcccggcctttaccaaggacactattgacatctccaagctgcccatttcctacaaaaccaacacacccaaggaggaacacctgctgcaggtggcagacaacttctcccgccagtacagccatctgtgcccggaccgcgtgcccctcttcctgcaccccctgaacgagtgtgaagtgcccaagttcgtgagcacaaccctccggcccacactgatgccctaccccgagctctacaactgggacagctgtgcccagtttgtctccgacttcctcaccatggtgcccctgcctgaccctctcaagccgccctcgcacctgtactcctcgaccactgtgctcaagtaccagaaggggaactcctttgacttcagtacgctgctctgctccatgcttatcggctctggctatgatgcttactgcgtcaacggctacggctcgctggacctgtgccacatggacctgacgcgggaggtgtgcccactcactgtgaagcccaaggagaccatcaagaaggaggaaaaggtgctgcctaagaagtataccatcaaaccccccagggacctgtgcagcaggtttgagcaggagcaagaggtgaagaagcagcaggagatcagagcccaggagaagaagcggctgagggaggaggaggagcgcctcatggaagcggagaaggcaaagccggatgccctgcacggcctgcgggtgcactcctgggtccttgtgctatcggggaagcgcgaggtgcctgagaacttcttcatcgacccattcacaggacatagctacagcacccaggatgagcacttcctgggcatcgaaagcctgtggaaccacaagaactactggatcaacatgcaggattgctggaactgctgcaaggacttgatctttgacctgggtgaccctgtgagatgggagtacatgctcctggggactgataagtctcagctgtccttgactgaagaagacgacagtgggataaacgatgaggatgatgtggaaaatctgggcaaggaggatgaggataagagcttcgacatgccccactcgtgggtggagcagattgagatctccccggaagcatttgagacccgctgcctgaacgggaagaaggtgattcagtacaagagggcaaagctggagaagtgggccccgtacctcaatagcaatggccttgtgagccgcctcaccacctatgaggacttgcagtgtaccaatattttggagataaaggagtggtaccagaaccgggaagacatgctggagctgaaacacataaacaagaccacagacctgaagacagactacttcaagcctggccacccccaggctctgcgcgtgcactcgtacaagtccatgcaacatgagatggaccgtgtcattgagttttatgaaacggcccgtgtggatggcctgatgaagcgggaggagacacccaggacaatgacagagtactatcaaggacgcccagacttcctctcctaccgccatgccagcttcggaccccgagtcaagaagctcactctgagcagtgcagagtcaaacccccggcccattgtgaaaatcacagagcggttcttccgcaacccagcgaagcccgcggaggaggacgtggcagagcgcgtgtttctggtcgcggaggagcgcatccagctgcgctaccactgccgtgaggaccacatcacggcctccaagcgcgagttcctgcggcgcaccgaggtggacagcaaaggcaacaagatcatcatgacgcccgacatgtgcatcagcttcgaggtggagcccatggagcacaccaagaagctgctctaccagtacgaggccatgatgcacctgaagagggaggagaagctgtccagacatcaggtctgggagtcagagctggaggtgctggagattctgaagcttcgagaggaagaggaggcggcgcacacactgaccatctccatctatgacaccaagcggaatgagaagagcaaggaatatcgggaggccatggagcgcatgatgcacgaagagcacctgcggcaggtggagacccagctggactacctggccccattcctggcccagctcccgccaggagagaaactaacatgctggcaggcggtgcgcctcaaggatgagtgcctcagcgacttcaagcagcggctcatcaacaaggccaacctcatccaggcccgctttgagaaggagacccaggagctgcaaaagaagcagcagtggtaccaggagaaccaggtgacgctgacacccgaggatgaagacctgtacctgagttactgctctcaggccatgttccgcatccgcatcctggagcagcgcctcaatcgacacaaggaactggccccactgaagtacctggctctggaggaaaagctctacaaggacccacgcctgggggagctccagaaaatattcgcttgatgtccctcctggggcctccgccagagctgccagagaaaggaaacctcttcccgcagcctggctcctgtgttccctctatccagccaatgcctgtttacacagacacctggcctcactgccagcccacctcccctacagccctgtttgttcctgcttctcatgattttcctgtaaataaacacactcttaatttgccaaaaaaaaaaaaaaaa

SEQ ID NO: 94 - DNA, 732 bp, Homo sapiens
catcggcgctttgccacttgtacccgagtttttgattctcaacatgtccgagactgctcctgccgctcccgctgccgcgcctcctgcggagaaggcccctgtaaagaagaaggcggccaaaaaggctgggggtacgcctcgtaaggcgtctggtcccccggtgtcagagctcatcaccaaggctgtggccgcctctaaagagcgtagcggagtttctctggctgctctgaaaaaagcgttggctgccgccggctatgatgtggagaaaaacaacagccgtatcaaacttggtctcaagagcctggtgagcaagggcactctggtgcaaacgaaaggcaccggtgcttctggctcctttaaactcaacaagaaggcagcctccggggaagccaagcccaaggttaaaaaggcgggcggaaccaaacctaagaagccagttggggcagccaagaagcccaagaaggcggctggcggcgcaactccgaagaagagcgctaagaaaacaccgaagaaagcgaagaagccggccgcggccactgtaaccaagaaagtggctaagagcccaaagaaggccaaggttgcgaagcccaagaaagctgccaaaagtgctgctaaggctgtgaagcccaaggccgctaagcccaaggttgtcaagcctaagaaggcggcgcccaagaagaaataggcgaacgcctacttctaaaacccaaaaggctcttttcagagccacca

SEQ ID NO: 95 - DNA, 2325 bp, Homo sapiens
cgcccggcagggttgtttcttaaaggtaaataagctccctaaatttgtctgtaaattggaagtaactccagtgaaaatgccaacaggaatttttttttggcttgacaaactaaggctaaaattaatatagaaatgagcatacaataataggaacactatgaaaaagaagagtaatgagaggtgggaccaagtctataagatattaaagggtaagtctctccggcccggtttccctcggtgtgctactgtgcgcgcgatccagcaccatggggaagcgggacaatcgggtggcctatatgaacccaatagcaatggcgagatcaaggggtccaatccagtcttcagggccaacaatacaggattatctgaatcgaccaaggcctacctgggaagaagtaaaagagcaactagaaaaggaaaagaaaggctccaaggctttggctgaatttgaagaaaaaatgaatgagaactggaagaaagaactggaaaaacacagagagaaattgttaagtggaagtgagagctcatccaaaaaaagacagagaaagaaaaaagaaaagaagaaatctggtaggtattcatcttcttcttcatcaagctctgattcttccagcagttcttctgattctgaagatgaggataagaaacaaggaaaacagagaaagaaaaagaagaaccgttactgaatcagacagtaaggatagtttaaaaaagaaaaagaagtcaaaagatggaactgagaaagaaaaggatattaaaggactcagcaaaaagagaaagatgtattctgaagataaacctttatcatctgagtccttgtcagaatcagagtatattgaggaggtgcaagcaaaaaagaacaaaaaaaaaaaaaccccacaaagtcaaaagacaagtttgaaaaatgtttacagctccacaaagatagacaaatttccttgatgtatgaaaaatgtcaacaaaccaataaaaagactaacaattcagtagaaaaatggacaaagaacaaatatggagattcatagaaatgagagataaatgtacatgatgagaaggtgaggtgctcacttgatttataagagaaatgaaaattaaaactacaccagatgccattttttaaaaacctattacattgatgaaaataaaaatttagcaaattgttagcctgaatggggagataggtacttgaattttgtgtgggaatgtaaattaggacagtctttatggaggataattttatagaatccatcagatttataaatgcacagacctatttgacccaacaatttaacatccagatttttatcttatgccaaactgaaatgaagaatggccaagttttattgaggcatcatttatagtagcaaaacactggaaacaagctaaatgttcattatagaagactggttaaataaaaatttgtccatcgaagatggagtagcatgtagttattaaaaaagaataaggaaaatactgatagaggatgatgtagatattaaatggggaaaaaagtaaaactccacaagatgtagaacagtatatgtgttttgctgccgtttgaggagaaaggagaaaatacagaaatatttatatgttgcttatgtatgcatacaacatttgtggatggattcacaagaaaatggtagccttaatttaccttgagacaaactgagggacaaggacaccctttaatacctttcagatatttttttttttttgagacagggttttgctcttgttgcccagcctggagtgcaatagcgtgatctcagctcaccacaacctccgcctcccaggttcaatcggttttcctgcctcagcctcccaagtaggtgggattacaggcatgcgccaccacgcctggctaattttgtatttttttagtagagatggggtttctcatattggtcaggctggtcttgaactcctgacctcaggtgatctgcccacctcggcctcccaaactgctgggattacaggcgtgagccaccacacctggctaccctttcagttttaagccataataaaaattacatgaaattgggctgggcacgatggctcactcctgttatcccagtgctttaggaggctgaggcaagaggatcacttgaggccaggagttccagaccagcctgggtaatgtagcgagaccctgtctctacaagaagataaaaaaattagctgggtgtcgtggtgcgtgcctataatcctagctactcaggtggcggaggtgagaggattgcccgaacccaggagtcaaaagctgcagtgagctactgtgatcatgcctctctactccagcctgggcaatagggtaagatcctg

SEQ ID NO: 96 - DNA, 457 bp, Homo sapiens
tttttttttttttttttcacttaaaaattttagtaatgagttaggtacaaatacaaaagcataaaacttactaatttgtataaaagttggttctcatctgttcccactttacatttttattagaattctttctctggaagattggacatattaaggttatctgcttaaatgagggtgaaaactttcctctaatattatggaggactcttaatataatattttgttctaacatataatttgatggagaaaatggctttggccacacgtggttgcttttggggtttctgaatttctcaaaaactgaacccattggaggcagagggcttaaagttagtatattcatatcaataaggaagaaagtggacagaattggtgtcatagtagtggagcatacagtcagcaggggttggagaagaggaagagaaaggatccagtcaactgagaaatttccgaggta

SEQ ID NO: 97 - DNA, 661 bp, Homo sapiens
catccagaaggctcattccgtggctgataattgaaactaacttctttctcactcaggtgtagtaactctgttttgggggcttatttccttgcttgcttccatagatgggcctatctttcttgccagtgattggttcaggcctaagccaattagtgcatagttttcccattggtcatggtagattgagatatggtttaataaaagtgactttgaatacttcatttgatggttgcagcaaacaagcttctctgtctttactcggaggaaccttgtttgctgatcatgaacacctcaaaatcatgagggaaagccagcctaagtaggaagccaaaaaagagacaagtgtggagctgaaggaattgtagggaaatagagctggagccctagacaaagaatgcccgaatctcccctacttccaaatacttcaggaactgagccactacatccacttaattgtttaagttagtatgggttaggttttctgataattacaggagaaagcattctaaccgatcgacgcagctaatataaatgaccaaaaaaagggtgaaataaaaggatgagattaacagttgctacttatgaaataaaagagaaatagacaaatcttcaaaaatgtaaatcaatgaatcaacaaaaaaaaaagaaaaaaacggcggcc

SEQ ID NO: 98 - DNA, 809 bp, Homo sapiens
cctaactagcctacatgctacttgaagccaggatcatcgtcttagacttctttatacagtacttaacatggtggtcaatacatagtcaaaataaaggccataaaacaggatgttttgacttcacctccatatcccatgcattttttcctaatgttctttgctttttgctccaagaaataaatacagacttgtattttttccaattctttgtgaatattactggtagaactaatctatacaaaatgaatttaacagaaatggagtagacttactttttcttatttttcccttaagtacaattaaaagccctcaacatcatacataaaacaaacatgagaacactgaaaggtggagagacgacagaccagctagggaccttgggacccaaggagccacacagtggtaaatttcctgggctttttttgacctcatatatctcagaccaggagccaaagaaaggaataaccccaagaaaccaagtgcagacaaaaaagccccaacacaagtcagctctttccagtcaaaggatcaagaaagggcaggctaacaagaaaaaaaactttagacaataaccactctactccaacaaactccacccttacccatgccagcaaagactgaggggggaacctagacttttaccctcgcaagctgaaacaaggagctccctcctcctgccctagcaatgccagcagagaccacagggggaactcagacttccaaccaccgccctccccagacattctctccccaccttccccaccttcccctgccaaataaagccttttttacacatccaaaaaaaaaaa

SEQ ID NO: 99 - DNA, 262 bp, Homo sapiens
acaagaactacagcgagaaaagggagacagaagaggatggacggttgcgtgtgcaatcaaattgcagatttttttcccatgcttactgtgtttgggaaaaaaaaaagtgaatcatgttcccccattcatgattacgaagcattgcatcctgccatattttcttcagtacttactgttcaatcacctctccacagaggtagtggggcgggggtaatgtatcaactttgtaaaataaaaaaattcaattagaaaaaaaaaaaaa

SEQ ID NO: 100 - DNA, 1070 bp, Homo sapiens
gcacttctgggcttcagcacacatcagtgtggttcacgtgtttcctgctgttatgaaagagattggagaggactaagcttggaattgcctgtcccacagcaagaggctatggagctgggccacggagcagggcccatctgaatgacaaggagggccaacaggacttggacccctggaaagcggcctacagttccttggacacctccaagttcaagaaccagggtctgtcatccccacagcccctgcccctgggatccagcactcaaggcagctccctagggcagtgccacttgaaggagattccccctccacccccgactgctgccagcagggattctctgggcatggacccacagtccaggtccctgaagaatgcgggctctcgatcctcctcgagagagaacagggccacctcgggagagggggctcagccatgccaggggacggatgacggtcccagcttgggggctcaggaccagaggagcacgcccacgaaccagaagggcagcatcattcctaacaacattcgccacaagtttgggagcaatgtggtggaccagctggtctccgaggagcaggctcaaaaggctattgatgaagtcttcgagggccagaaaagggcaagctcatggcccagcaggacccagaatcctgtggaaatctcctccgtcttctcagactactatgacctcggctacaacatgcggtcaaacttgtttcgaggggctgctgaggagacaaagagcctcatgaaggcttcttacacaccagaggtcattgagaaatcagtgagggacttagaacactggcatggcaggaagacggatgatctggggcggtggcaccagaaaaatgctatgaacctgaacttgcagaaagcactggaagagaaatatggagaaaacagcaaatccaagagctccaagtactagttttgacacagtagaggtgtcttctactcaaataaagtgctaacaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 101 - DNA, 2197 bp, Homo sapiens
gaaaatgatgcaaacatgtagtaacaagttttaaaggtgtgtgattattactgcagttacttactagattcttatcccctgtcctgcaccccctccttttccatcactttattgacccaagggcaagaacatgtagattcccacagaacaccctaatgcagaaacagacactctagcacatgcacaaatactccaacccatcaattcattcccagctccgtctgatttctaaatagtccacactcttgtgaatactttttaaaattcctattattagctttcaacgttctcccctgagcagtccagagaattcccatgtttgagtctgtctcaggctttcagcatcccaaggaaagaagcacctcaccttctagcagagccaaaaccacagactttcttaaccaagggaccccttgggaattcctcctcaccagaaccccaccactccctccgctttgggcgcctggttcagtacagaggtacacagccccatagaacttcagcaacacggtttggagaagataactctgtttgatggactctttagagtcagtcttagaacatccaagtcctttcctctccctgtcaatttccccttttatggcattaaactctcttgaaaaacatagctatgccactcgacagtttctagtcaagaatgagacggaatgtgggagagggatattaaaagccctaatcccctcttctgatgttcgaagaaaggcaagaccagattcttgggagatgcagagattaggggcatctgcgttctatgcagcacagttacccagccctttgatgggctcttcatcgttttgtgactagctcttagaggggaagaaccttgccttagctgctaacagtggttgattcttgaaagcttatgtaatcctagagacatatccaggcatattgggattgccaataaagatgtcacttgtttccacgttggggttctccttattgactcatgagcaccacaatagagtctatacacagacttagtttggggttcttggttgggatttcagcattagaaatagatgcagcactcatggaaaaacatcatgagtgcatctgagccaattttagatgatttcattaattctgcataccttctctttgacccattgatgcaggcccacatctatccagccccaactgtcttatttgcctttaacccattctggaattacccagtatgacttatattatttctatgcacatgagaatccaaggttttagaaacctggcatgcttataactactgctgacagtccctcatagtcagggcttaaagcgccaaaatacacggaaacataagagaaaaagtcccccagtgagaaacctgattgatggaaggggaagaatgtgtggaatatgaatgttaccttccaaaagtgaaggcagagcaaaattaagcatgtttagccctggatttgagccaatccaacataaggaaattttgttttttttaagtagcattgcttttagaacctgtgaattttccttttgcatgaagatgagtgcagtactgtcttcaaaatgattgtagaatttcttggtagctttacaccgaaaaatgcgtgtaactaaataccagacatcttgaccattcagctagaaccctggcagcaacagagctatttaattgtacaaatgtgtgtaaggattatttttagtgtactaataaattaaaaacaaagctaccctgtcctcgttagtcattgctattcaatcattccagtcccaagttatttttgtgccacttggaatatgagtatttctattggtaactacaaactctatcctgtgtttgtaagaggagccgtgtaagatttttttcatttaaagggacaatttacttcattatttatctttcttttgttatagcgttgtaattcttctcagtttttctttgcacatttcaatatgcatggtttaaaaaccattaacttctctaccttttgtacagtaaggtttcattttcacactgtatagtttcattttattgttttgctttgtcagttatatacagtataaagttgctatgcacagagctttttgtaaagacagcttttttgtttactgtttttaatggtcttacttaaagaatatcttgtttgtaaaatgaatatgtctacttcagttttaaactttaaattatcctaacaaaaaaataaaatttttgtactgt

SEQ ID NO: 102 - DNA, 1789 bp, Homo sapiens
aggggctgaatacacagagcgctgagagagtggggcagtgtggtcacggacacaggtcatgggggccttggcaggagcggttttggcagagggtggggccggtgcctctggaaggtatgaagatgtaaatgaagccctgtccaggctatgggcatcaagacagcattgccggcggctgagctgggcctctactctctggtgctgagtggggccctggcctatgctggccggggcctccttgaggcttcacaagatggggcccacaggaaggccttccgggagtctgtgcgacctggctgggagtacattggccggaagatggatgtggctgacttcgagtgggtgatgtggttcacctcctttcgcaacgtcatcatctttgccctctccggacatgtgctgtttgctaaactctgcacgatggttgccccaaagctccgctcctggatgtatgctgtgtacggggccttggctgtgatgggcacaatgggcccttggtacctgctgctgctgcttggtcactgtgtgggcctctatgtggcctcgcttttgggccagccctggctctgtcttggccttggcttggccagcctggcctccttcaagatggaccccctaatctcttggcagagcgggtttgtaacaggcacttttgatcttcaagaggtgctgtttcatgggggcagcagcttcacagtgctgcgttgcgccagctttgcactggagagctgtgcccaccctgaccgccactactccttagctgacctgctcaagtacaacttctacctgcccttcttcttcttcgggccaatcatgacctttgatcgcttccatgctcaggtgagccaggtggagccagtgagacgcgagggtgagctgtggcacatccgagcccaggcaggcctaagcgtggtggccatcatggccgtcgacatcttctttcacttcttctacatcctcactatccccagcgacctcaagttcgccaaccgcctcccagacagtgccctcgctggcctagcctattcaaacctggtgtatgactgggtgaaggcggccgtcctctttggtgttgtcaacactgtggcatgcctcgaccacctggacccaccccagcctcccaagtgcatcaccgcactctacgtctttacggaaacgcactttgaccgtggcatcaacgactggctttgcaaatatgtgtataaccacattggtggggagcattccgctgtgatcccagagctggcagccacagtggccacatttgccatcaccacactgtggcttgggccttgtgacattgtctacctgtggtcattccttaactgctttggcctcaactttgagctctggatgcaaaaactggcagagtgggggcccctagcacgaattgaggcctctctgtcagtgcagatgtcccgtagggtccgggccctgtttggagccatgaacttctgggccatcatcatgtacaaccttgtgagcctgaacagcctcaaattcacagagctggttgcccggcgcctgctactcacagggtttccccagaccacgctgtccatcctgtttgtcacctactgtggcgtccagctggtaaaggagcgtgagcgaaccttggcactggaggaggagcagaagcaggacaaagagaagccggagtaggagggagcgggtagagggatgggctctgctcagctattcttgggccagatggggcctgaccgatagaataaaagacttttctacaacaaaaaaaaaaaaaaaaaaaaaaacaaaaaaaaaaaaaaaa

SEQ ID NO: 103 - DNA, 1527 bp, Homo sapiens
atgacgtccacctgcaccaacagcacgcgcgagagtaacagcagccacacgtgcatgcccctctccaaaatgcccatcagcctggcccacggcatcatccgctcaaccgtgctggttatcttcctcgccgcctctttcgtcggcaacatagtgctggcgctagtgttgcagcgcaagccgcagctgctgcaggtgaccaaccgttttatctttaacctcctcgtcaccgacctgctgcagatttcgctcgtggccccctgggtggtggccacctctgtgcctctcttctggcccctcaacagccacttctgcacggccctggttagcctcacccacctgttcgccttcgccagcgtcaacaccattgtcgtggtgtcagtggatcgctacttgtccatcatccaccctctctcctacccgtccaagatgacccagcgccgcggttacctgctcctctatggcacctggattgtggccatcctgcagagcactcctccactctacggctggggccaggctgcctttgatgagcgcaatgctctctgctccatgatctggggggccagccccagctacactattctcagcgtggtgtccttcatcgtcattccactgattgtcatgattgcctgctactccgtggtgttctgtgcagcccggaggcagcatgctctgctgtacaatgtcaagagacacagcttggaagtgcgagtcaaggactgtgtggagaatgaggatgaagagggagcagagaagaaggaggagttccaggatgagagtgagtttcgccgccagcatgaaggtgaggtcaaggccaaggagggcagaatggaagccaaggacggcagcctgaaggccaaggaaggaagcacggggaccagtgagagtagtgtagaggccaggggcagcgaggaggtcagagagagcagcacggtggccagcgacggcagcatggagggtaaggaaggcagcaccaaagttgaggagaacagcatgaaggcagacaagggtcgcacagaggtcaaccagtgcagcattgacttgggtgaagatgacatggagtttggtgaagacgacatcaatttcagtgaggatgacgtcgaggcagtgaacatcccggagagcctcccacccagtcgtcgtaacagcaacagcaaccctcctctgcccaggtgctaccagtgcaaagctgctaaagtgatcttcatcatcattttctcctatgtgctatccctggggccctactgctttttagcagtcctggccgtgtgggtggatgtcgaaacccaggtaccccagtgggtgatcaccataatcatctggcttttcttcctgcagtgctgcatccacccctatgtctatggctacatgcacaagaccattaagaaggaaatccaggacatgctgaagaagttcttctgcaaggaaaagcccccgaaagaagatagccacccagacctgcccggaacagagggtgggactgaaggcaagattgtcccttcctacgattctgctacttttccttga

SEQ ID NO: 104 - DNA, 615 bp, Homo sapiens
caaaaacaccaataatgagcactgaatacatttatgtttcgggattacaattaaaacaactattggaattatggttgcgaaacaaaacaaatgctataaaccattataaagcagaaactgtaaaacccaatgaaggtaagaatgcgttaagtatcttgattttctcatttttttgtagttgaaggccaagaaaagatacgtttaaagtctgtagcccagctattagggatacaaataagtgtgaagttatacaagaaccctctagagagaggctgttggccagaggtagcatctgcttctttggtggtcttggagcttgagagtgttgatgtcatttggtgtgtggggaccaaagataatgagcaaactgtaaaatgcttgactgtcttggacaaagacgatttttctcatacaaacactcacagtgtccctacggaacagtaaagcagtagaactaataatagcaataaccagcccaaattgaatggaggagagaagagagaggatttgggagaaagtggttttgtcattactcttggtgaagagtcaattgattatatccgaagaaatgtaggattgaataaattatatacaaatatgaaaaaaaaaaaaaaa

SEQ ID NO: 105 - DNA, 3080 bp, Homo sapiens
gaaaaaggaccattttgccagtgaccccaattctatttgagtgtaaccacccactgctggggattgaggctgttgttggaaatgtcctaggttttatttcctcattgcaatttcctggcagccctgctccaaggctagatgaaatcttcactcttgccagagccattctcaataaacatttgctgaagaaatgcttgctacctgaatgaatgatcagaagccggaaaaatcagctttcaaaaggagcttaggaacaagcaggacaaatggaaacactgccatcaatttcagaagcctttccaacagaactgccagagccttcaggcttctttggtgggacaacgacgtggccaagaagtggaaagatccctggacattgggatctagacacagatgtgacactaaagtgccgtgaggcctgggagaaatcacctaattgctcaggcctcagtttcctccatagagatatgcactgggcccctactatattccaggcaatgttcaaggcacagtggacacactgttgtgtaagacaaaaaaggtcctttatcaggtgacaagtgccaaagagaattcaagtaggtgatgggatggagagtgcctcagggtgatactcatgaaggagccatccatgcaaactgtcgggaggagcactgtaggaagagggaataaatagcttgcgcaaagatttagactgctcccttgtggtttgcattcatttctgttgattttgccttaagattgttatgacaaccatactctatgcattgggaaataatctgtggcttcatacagaaatgcactcatccctcaatggatgagtgtaactagtccaaaatttttgctcataatcctggactggtattgtcaatcaaccattagttattgttaaaggagtaatttcataaagaaatttataataaagtgcttcgtattgccacatgtcaatactcaggcatgtcttcactagaaagaatgagaagccatcaaatgattgcccgtttaggtggaatcgctgtgcatgtgcaggaatgttgcaatagtggctcagatacagccagtagctcctctaagggtgaggtgattttctgaaatagtaaacatttctagacaaattttgaaacaaaacgaagtacatccttttctacattgacacagtcattgcattcctggaaaattccatgtaagtactttgtatttaatatataatattgcataatgatccaggctcagataatgattggcaggcaaaatgaaggaccttctcactatagtgggatatctagcattcctgaccctgcctgctaaatgccagttgcagcccccctttccaatcatttcaacaataaaaattgctcccatgaaattccaagcactcctcaggaatgagaaccactgaaccactggaaggagtttggatttattcaaagtactatgggaatccactggaagattttattctgggaagtaacataaactgatttgcatttttcagagtgctctggatgtcgtgtgagaagtgatggtagcaggggcaagagtggtggcagggagactttggcaacagataactagcctcaggcaaggcagcaggcaaggagcagagatggaaagaaattcatagattaaggatgttttcagggtggaggcaacaggttttactgatggtgttgatgtgagatgagaaaagatttttggctttagcaacggagagaatgatacatacctttatggaacctagaagaaatccatggcttttgtcttcttaatgtttttaaatttaacatggcccacactgaactcatgatccccatgccactcccaagtttgagatgacagccatgtggagatgtcaagttagatatatgagttcctgtgagatgctctggctggagacacatctgggagtcaatggtacacagaaggcatccaaaaccacgggattggagacgtgaggtcaccttgggagggtgggtggatggaggagagaaaggcagccaggacagagcctcggggaccttcaacactactaaatgaggcacactcttctattaattactccattaagagaaagactgaggtttttaacattaattttaatgggaatactcaatgattgatgacaccagttttggcttatgagcagaaattttggaactaattatactcatttatcaaagcatgaggatggacttcttcatgaatttcaaattatttcccaatgcatagagtatggatatcataataatcttatgataccaaagtagtaattaatgtttggattaagagcaggctacataagggaggccttggacttacggtctcatgaaaaattacagataaagtccattaatcagtatttattggtcacccacagaacaggctgtgaaatttttcagtttaaaaattactttcacattttctaagggaacttgatagattcaattttctaaattaaaaaaaattaacagccttattgaggtataactctcataccatacaattttaatctttaatttgaagtggttacagtgcattttcaaatagacatatgtaagttagaaactaaattaccctgccagcttaacaaaacataaaacagcaattactgtttattaggcatcaacttaggtgacaggtacgataagcagcatttaattgatcccaatcctcccagcatccctgaagagtatatcttccattttacagagagaaaatcccacctcaaaggatctggagaactggccagagatcaccccagaagagagtacaggagccaggatttggacgcaggtctctctgactcaaatccttttctctttcccttacttcatcctccccctcatctcctgaaaattagaagccggatcctggaatacacacagaaaaccctccacccattttaaggatacatcaagatcaaaactcattgatattgtaatcttactagtttgaactttaaaacattttactgccatatggggactggcttcaaagaaatgttttagtggtgttacgtttaatgccttgtgtttatgtagaattacatatcctataaatgttaaaaaaaaaaaaaaaaa

SEQ ID NO: 106 - DNA, 9732 bp, Homo sapiens
gctggaggcaggaatgtgcctgcttactaatgagcgacgtgcaccggcgcgcacggcccggccaccgctgcggctgcggcggccggcggcggcccgttgtcaggtggagcctttgaattttttaaaagaccatagtaatcagatctacttgaaaaattaagtgaattgatttggttggaatgctcttttaccgatgctttaacatacagccactagattcccagaagttgtgcatgagttcctgtgaggagagttggcatcttggaaatcaaagacggttgtgatgcagttttttgatatgaggataacaggaagcgtcaggacaatcatgcccataagaactctaaactgttcagatcattttatcttagtgaaactggcaattgaactttgctctagttgatgggcaaaatttctcctagactattcatcatcccaatttcatcctagttgaaaattttcaaatgccataagaaatctttatagatttgcacttagcttttggatggacgtttctacaatggagagaactgtgttatagccctggtccaaggacattactagctaatgcccatcgactgtggtgtgcgtgtggaaggttccaaagagaaggagcaatcagcaagtttgcagacaccctggaacatggaagcaaccaagctttaagaagcacagctttggagacactccatgagtctgcactgctttcaggggaactagcacttaagaccttgtgtaacaaaatggacactggggacacagctctaggacaaaaagctacctcaaggtctggagaaactgataaagcatcaggtagatggagacaggaacaatcagctgttattaagatgagcacttttggcagtcatgaaggacagcggcaaccacaaatagagcctgagcaaatcggaaacacagcatcagcacaactgtttggttctgggaaactggcctcccctagtgaagtggtgcagcaagtcgcagagaagcaatatccaccgcatcgtccgagtccttactcatgccaacactcactctctttccctcagcactcattgccacagggggtcatgcacagcaccaagccacatcagagcctcgaaggtcctccgtggcttttccctggccctttgccatccgttgcctctgaggacttatttccttttcctatacatggccacagtggtggttatcctagaaaaaagatttcaagtctgaaccctgcttatagccaatactcccagaaaagtattgaacaggcagaagaggctcacaagaaagagcacaaacccaaaaagcctggcaagtacatttgcccttactgcagcagagcgtgtgccaaacctagtgtactgaaaaaacacatcaggtcccatactggggagcggccatatccatgtataccttgtggtttctctttcaagacaaagagcaatttgtacaagcacaggaagtcacatgcccatgcaattaaggcaggattagtacctttcacagagtcagctgtatctaaattggacctagaggctggttttattgatgtagaagcagaaatacattcagatggtgaacagagtacagacacagatgaggagagttctttatttgccgaggcttctgacaaaatgagtcctggtccacccatcccactggacattgccagcagaggcggctatcatgggtcattggaagaatcattgggaggtccaatgaaggtgccgattttgattatccctaaaagtgggattcctctccctaatgaaagctctcagtatattggccctgatatgctaccaaatccatctttaaatactaaggctgatgattcgcacacagtcaaacagaaacttgcactaagactgtcagagaaaaaaggacaagattctgagccatcgctcaaccttctgagcccgcacagtaaaggaagcactgattctggttacttttctcgctcagaaagtgctgagcagcaaataagccctcccaacacaaatgcaaagtcttatgaagaaatcatctttggaaaatactgtcggcttagtccgagaaatgcactcagtgttacaaccacaagtcaggagcgtgccgcaatgggtaggaagggcataatggaaccattacctcacgttaacaccaggttagatgtcaagatgtttgaagatcctgtttcacagctgatcccaagcaagggagatgtcgaccccagtcaaacgagcatgctgaaatccactaagttcaacagtgagtccagacaaccccagattattccatcatctatcaggaacgaaggaaaactttatccagcaaacttccaaggcagcaacccggttctcttagaagctcctgtagactcttcaccccttattagaagcaactcagtgccaacttcttcagcaactaatctaactattcctccttctttgagaggaagtcactcatttgatgaaaggatgactggttccgacgatgtattctatccagggaccgtgggcataccccctcagcgcatgctaagaagacaagcggcatttgagctgccttcggtacaggagggccacgtggaagtcgagcaccatggcaggatgttgaagggtatcagcagttcatccctgaaggaaaagaaattgtctcctggggacagggttgggtatgactatgatgtctgtcggaaaccctataagaagtgggaggactctgaaacaccaaagcaaaactacagggacatttcctgcttgagttctttaaagcatggtggagaatatttcatggatcccgtggtgccattgcagggagtaccaagcatgtttggaactacctgtgaaaacaggaaacgccggaaagagaagagcgtaggggatgaagaggacacgcccatgatctgcagcagcattgtaagcactcctgtgggcatcatggcttccgattatgaccccaaactgcagatgcaggaaggagtcaggagtggatttgccatggctggacacgaaaacctttctcatggtcacacggaacgctttgacccatgtcggccccaactgcagcctggaagtccatctcttgtgtcagaggagtcaccttcagccattgattcagacaagatgtcagacctagggggcaggaaacctcctggaaatgtgatttctgtgattcagcacaccaactcactgagccgacccaattcatttgaaaggtctgagtcagccgaacttgtggcttgcacacaggataaagccccttccccttcagagacttgtgacagtgagatttcagaagccccagtgagtcctgagtgggctccacctggggatggtgcagaaagtggggggaaaccctctccatctcagcaggtgcagcagcagtcctatcacacacagcccaggctagttcggcaacacaacatccaggttcctgagattcgagtgaccgaggagcctgataaacctgagaaggagaaggaagcccagagcaaagagccagagaagcctgtggaagaatttcagtggccccagagaagtgagaccctttcccagctccccgcggagaagttgccacccaaaaagaagcgtctgcgacttgcagatatggagcactcctcaggggagtccagctttgaatccacaggcacaggcctctcccgcagccccagccaagaaagcaacttgtcccacagctccagtttctccatgtcttttgaaagagaagaaaccagtaagctttctgcacttcctaagcaggatgagtttgggaagcattcagagtttctgactgtccctgctggttcatactcattgtctgtcccaggccatcaccaccagaaagagatgcgacgctgctcatcagagcagatgccttgtcctcacccagcggaagtcccagaagttcggagcaaatcatttgattatgggaatctgtcccatgctcctgtgtcgggagcagcagcctccacggtatcaccgtccagggagaggaagaaatgctttctggtgcggcaagcttccttcagtggctccccagaaatctcccagggcgaggttggcatggatcagagcgtgaagcaagagcagctggagcacctgcatgctggcctccggtccgggtggcaccatggcccgcctgctgtgctgcctcctcttcagcaagaggacccagggaagcaggtggcgggtccttgtcccccgctgagctcggggccactgcacctggcccagccacagatcatgcacatggacagtcaggaatctttgagaaatcccttgatccaaccaacatcctatatgacaagcaagcacttacctgaacagccacacttatttccacatcaagagacaattccattttctccaatccagaatgccttgtttcagtttcagtatcctacagtttgtatggttcatttaccagctcagcagcctccctggtggcaggcacatttcccacatccctttgctcagcaccctcagaagagctatggcaagccctcttttcagacagaaatccattcgagctatcccttagagcatgtggcagagcacactggaaagaaacctgctgagtatgcacacacgaaagagcagacctacccatgttattcaggagcatcagggctacacccaaagaaccttcttccaaagtttccatcagaccagagcagtaagtcaactgaaacgccctctgagcaggttcttcaagaagattttgcctcggcaaatgctgggtctttgcagtccctcccaggaacagtggttcctgttcggatccagacgcacgtaccatcctatggaagtgtcatgtacacaagcatttctcagatacttgggcagaatagccctgccattgtcatatgcaaagtcgatgagaatatgacccaaaggacactggtcaccaacgcagccatgcaagggataggattcaacattgcccaggtgctggggcagcatgcgggcttggagaagtaccccatttggaaagcacctcagactttgcccctcggcttagaatcctccatccccttgtgtttaccttccacctctgacagcgtggccaccctgggaggtagcaagcgaatgctttctccagccagtagcttggagctcttcatggaaaccaagcagcagaaaagggtcaaagaagaaaagatgtacggacagattgtggaggagcttagtgctgtggagctgaccaactcagacatcaaaaaggacctctcccgcccccagaaaccccagctggttcgacaaggatgtgcttctgagccaaaagatggcttgcagtcagggtcatcttccttctcctcgctgtcgccctcctcatctcaagactatccttctgttagcccgtcttccagggagccattcctgcccagcaaggagatgctttccggttcccgggcaccacttccggggcagaagtccagtgggccttctgaaagcaaagaatcttcagatgaattagatatcgatgagacggcatcggacatgagcatgagcccacagagttcttcattaccagcaggagatggtcagctggaagaggaagggaagggccacaagcggcctgttggcatgctggtccgcatggcctctgcccccagcgggaacgtggcagactcaactcttcttctcacggacatggcagatttccagcagattcttcagttccccagtctgcggacaacaactactgtgagttggtgcttcttgaattatacaaaacccaattatgtgcaacaggccaccttcaaatcctcggtttatgcttcatggtgcattagttcctgtaatccaaacccatcaggattgaacaccaagaccacgctggctcttctgaggtccaagcaaaaaatcactgcagaaatttatactctggctgctatgcataggcctggaaccggcaagcttacatcatcaagtgcttggaagcagtttactcagatgaaacctgatgcgtcctttttatttggcagcaaactagaaaggaaactagtgggaaatatcttaaaggaaagagggaaaggagatattcatggagataaagatattggatccaaacaaactgagccaatccgaattaaaatatttgaaggagggtacaaatcgaatgaagattatgtatatgtcagaggacgtggccggggaaagtacatttgtgaagaatgtgggattcgctgtaagaagccaagcatgctcaaaaaacacatccgtacccatactgatgttcggccttatgtatgcaagttatgtaactttgccttcaaaacgaaaggaaacctaacgaagcatatgaaatctaaagcacacatgaaaaaatgcctggaattgggagtctcaatgacatcggtggatgatacagaaactgaggaagcagaaaatttggaagatttgcacaaagcagcagagaagcatagcatgtccagcatttcaactgatcatcagttctccgatgctgaggaatcagatggtgaggatggagatgataatgatgatgatgatgaagatgaagatgactttgacgaccagggagatttaacaccaaaaacaagatcaagaagcaccagtcctcagcctcctagattctcctccttgcctgtgaatgttggcgccgtaccccacggggttccttcagatagttccctgggacattcttcgttgatcagctatttggttactttgccaagtattcgagttactcagcttatgacacccagtgattcatgtgaagatacccagatgacagaataccagaggctattccagagcaaaagtacggactcagaaccagacaaagacagattggacatacctagttgtatggatgaggagtgcatgctaccttcagagccaagctcctctcccagggacttctcaccctcaagccaccattcctctccaggatatgattcttcaccctgtcgagataattcaccaaagaggtatctgatacccaaaggagatttatctcccaggagacatttatcacctaggagagatctgtcacccatgagacatctttcaccaagaaaggaagctgcattgagaagagagatgtcccaaagagatgtttcaccaagaaggcatttgtctccaaggaggccagtgtctcctgggaaagatatcacagcaagaagagacctctctcctagaagagagagaagatacatgaccacaataagagcgccatctcccagaagggctttataccataacccaccattgtccatgggacagtatttgcaagcagagccaattgtattggggcctcctaatttaagaagaggattacctcaggttccttacttcagtctctatggagaccaagaaggtgcttatgaacatccaggctccagccttttccctgagggtcctaatgactatgtcttcagtcatcttccactccactctcagcaacaagtgcgagcccctatccccatggtgcccgttggtgggatccagatggttcactccatgccgccagccctttccagtttacatccttcacccacattgcccctgccaatggagggctttgaggagaagaaaggcgcgtcaggggagtccttctccaaggacccctatgtgctttctaagcagcatgagaagcgaggtcctcacgctttgcagtcatctggtccacctagcactccctcctctcctcggctgttgatgaaacagagcacttcggaagacagcctaaacgcaacagagcgggaacaggaggaaaatatacagacttgtacaaaagccattgcctctctccggattgccacggaagaggcagctctgctcgggccagatcagccagcgcgggtgcaggagccccaccagaaccccctgggaagtgcacatgttagcattagacactttagtagacctgagccaggtcagccctgtacctcagccacccaccctgacttgcatgatggtgaaaaggacaattttggtacatcacagactccattagctcactccacgttttacagcaagagttgtgtggatgacaagcagttggactttcacagcagcaaggaattatcttcaagcacagaggaaagcaaagatccttcatcagaaaagagtcagctacattgatctatgatgcatggagactttcatttccacattttcccatttttttgtttttgtttttctagaaatggaggtaatccagtttatagcatgcctgtcctaagttacagtagtttgctattatatatacttttgttatatcaaaagaattaggtaaattaacaagtcatcatgagcctgaccaaaacaaaatttgaaattaacctattgggtctggtacttttaaaattgtacagatgtttgtgccttttctttactttgcttatattcttataagcattttttagcagtaatttgtacatattttagaatttgtgtatctgctttgtaataaatgtaatttctttccttttttggacacttggatctaaatgatgtaaagcaaaacagcatcaatatatatgtgaggttgcactaaaacatatttttatatgattaaaactgaacagcttttatgtacagctctgattctgtaatactaatatttatttactttgtttcataaattgtacattttttcttaatgttgtggattgcttttctatgtgaagcatgggatttactgttgcgtaactagaacaaaaatgtacattgtaaacaagatatttaaactagagtatcttattctgcacttatgcattagttaaaaaaagataaaggatgtatcagtcagttcttaactcttgtatatttttttgtctcttgtttgctggattgactataacttaagtgctgattgtgattttaaaatgatagtaccgtaaagcattaaagtaaacaatgtgctattgtgagttttttcaaagctttataaatcagttataaataatattaaaagtatttggtcttatgtgaacatgttgatctatatactcatctaaaaatatgggaaaacattccaccccatgtaaatatgtacaagtgcatcactggtacaattttatgtaactcagttggacactaggttgccacagacctatgctaggtgtctttaaaaaattaaggtgacaaagcacatgggactgtgtagagcttggttatcggccggcccggtggcttggcaggcagtgctgtgcgctgctcatggagaagacctgggcttagcaatctccttagttcttgctacacaggatggtgactggaactaaggctacacagagggtcgcacttggactctgagggttgggtgtggaagggggaaaaggagatggagacctgctccccagctcttcctgtcagccggtttacatgggaacagggttaacatctgtgttaggggaggtcaccttaccctttttcataggggaagagtgtcacactcctggctatctcagggggaatggggaaaagaatctttcaagggcaaagaactcgtgggaggatgtctgttgtatgtaatactcacaatggcttttggttagtgttgaaggtgggaagagcatttgtaggtccagaagagtgaaagagagggaggggtgcagcaacatgtgcacaggcacgcacatgtgtgcacgcacacatacaatctgggttatctttgtgctatatagtggattataattctgtgaaaccaagtttgtatattgaattacattaaggagtgttctttaaaaagagaaataaatatacaattacatgcttgaaaaaaaaa

SEQ ID NO: 107 - DNA, 3416 bp, Homo sapiens
cagtttcagggtctcgccggcagccccagccggcgggcgcggagcgggcagcggggcccggatcgcaggctcctctgggggccccggagttgggaagcggcgtccgggagcccccggaggaggatgggctgcagacacagcaggctgagcagctgcaaacccccgaaaaagaagcgccaagaaccagaaccagaacagccacccagaccagagccccatgaattaggtcccctcaatggggacacagctataactgtccagctctgtgcatcagaggaggctgagcggcaccagaaggatataaccagaattctccagcaacatgaggaggaaaagaagaaatgggcacaacaggtggagaaggaaagggagctagagcttcgagacagactggatgagcagcaaagggtcctggaaggaaagaatgaagaggccctgcaagtcctccgggcctcatatgaacaggagaaagaagcgcttacccactctttccgggaggccagttctacccagcaggagaccatagacagactgacctcacagctggaggctttccaggccaaaatgaagagggtggaggagtccattctgagccgaaactataagaaacatatccaggattatgggagccccagccagttctgggagcaggagctggagagcttacactttgtcatcgagatgaagaatgagcgtattcatgagctggacaggcggctgatcctcatggaaacagtgaaagagaaaaatctgatattggaggaaaaaattacgaccctgcaacaggaaaatgaggacctccatgtccgaagccgcaaccaggtggtcctgtcaaggcagctgtcagaagacctgcttctcacgcgtgaggccctggagaaggaggtgcagctgcggcgacagctccagcaggagaaggaggagctgttgtaccgggtccttggggccaatgcctcgcctgccttccctctggcccctgtcactcccactgaggtctctttcctcgccacatagggtgcagggcctgggcccaccacgacgcctgaagtcacagctccttccaaggtttttctggagaagacagcaggagcctctcagttcttttccaggaaggaacgagggtgggagcgagatggagatcctgggtgtgtgcccagtgagccctggggccttgagttacatggaatcacccacagggttttggaggccccgagaagcgtcttcccttgagttggccaagggaataagcaagaggagacatttcctccctgccccagcactctgtcccaatccgagaagttccgaggctttcccaggggcagtctgtgtcacgctggccatttgacataaaggagacagcccctggtcccagcttgtcagctctgctgccgacttgctgacttatcaacttcctctaggtgtttccactccaccctggcctgctcagagcctcagtttacccctgcattaaaatggtggggggactggtcaaaggactcttatgtcactgcagtgtcccattctaggattgtctgaaggccagagtaggggttggggggagtgtggacaaaccccgcaaatcagagtggggaaggtgagtggtagagagggggtctctgaaggcccttggggctgacagggccaggcagcctccccagctgaggcatcattcctgggccagagtcgtgtccaccaagggacagtagccagagctcctcttcctttaccaggcaaggtgcatcccctcagccctcctggcccttcagtcttggtgccacctgggcacaggggcaagcttggtggttgtgagtccattcatctatcagagctggaacctcatccctgcacagatgaggaaaccaaggcatggagcagttcccagagtcgaatctagatctcatctgtcatccgggtcttatcctttgctctgtttttctcttcaggctctggaaaatcagatctgtgacttaatcttcctctccctggccctcacccacttagtttctttttcattcctgctccctgccttaactcctcctcccactgcccctgatcccaggcccaggcttttacaacctggtgctcagcttccccatcagtgaaaaggggtggctagagtaactaacctcagcaggccgtccagtcctgatagtctgtggatttcggatccttctcaggaagcttcatgtctaatggagactataattataactcctgttctgcatagagcatttgcatcaaaggctttccatacccctccctcccctggtcctcataagatccttgaagcaggttcctattcctcattggcaacatggcaaacagatcacaggagtcaaagggccttgctcaaggtccccagcttcagccccaggccctaagccagcgtcagaacagtcaatctgcatttttcatcagtcattctatagtgacatcatcccagactgccttctgtattcccctgtgtacagtctccttctgtttctaggtttagaagttcagaggtgactgtgtttctccatttccacagccaaatgggggaagaggtgaggctaggggagtgctgtgctgattctccagccatggtcagacaggtcacccaggagcctcgaggaaagccctggagggaatcacatgtgtactttttcatgaagctttttgcaaagcacatctgcgatacactagtttattgaactaatgtccaggagtagacatgattggtggccaagttatttggggacacctaaacagatcagtgacctgaatgacttctcagaacctttaatatgccaatgtgtgtggcaaacttacaagaagggagctaagtatccagcctctcccaaacctctttgaacaaagcttctgtccctcccacacctctcacctcacaggcacatcaggctgcagaatgcgctttagaaagcattgttttagtccaggcacagtggctcacgcctgtaatcccagcactttgggaggccgaggtgggtggatcacaaggttgggagattgagaccatcctggctaacacagtgaaaccctgtctctactaaaaaaatacaaaaaattagcttggcgtggtggtgggcgcctgtagtcccagcagcttgggaggctgaggctggagaatggtgtgaacccaggaggcggagcttgcagtgagccaagatcgcgccactgcactccagcccgggtgacagagcaagactccgtctcaaaaaaaagaaaagaaaaaagaaagcattgttttaattgagaggggcagggctggagaaggagcaagttgtggggagccaggcttccctcacgcagcctgtggtggatgtgggaaggagatcaacttctcctcactctgggacagacgatgtatggaaactaaaaagaacatgcggcaccttaaaaaaaaaaaaaaaaaa

SEQ ID NO: 108 - DNA, 1682 bp, Homo sapiens
cttctctctggcccgagccaggtcagtccggcagtgcagatggcccatcccgggctctgggctcctagaccggggtgggccctgccaggagtgggcctgagcctcgcacgtcctctgaaactacgctatgctctgcttttgcggcgcgatgggcgtgggagcgggggctgcccaaagatgggctggggttggaggaagtggcccggtagccgctgtgtgtcctgaggccgtaaggcgcctgaccccacccctgaagctggcgacggagcagggcctgttttctctacactatagtcatgatccgctgggcccccagcgcatctcctggaagagcccactcaccctggacgagctcttcggtagcctcagaccgtccttgaagaggatgactgagacattatgggccacgcgctgtgtgtctgctctcggggaactgtcatcattgacaataagcgctacctcttcatccagaaactgggggagggtgggttcagctatgtggacctagtggaagggttacatgatggacacttctacgccctgaagcgaatcctgtgtcacgagcagcaggaccgggaggaggcccagcgagaagccgacatgcatcgcctcttcaatcaccccaacatccttcgcctcgtggcttactgtctgagggaacggggtgctaagcatgaggcctggctgctgctaccattcttcaagagaggtacgctgtggaatgagatagaaaggctgaaggacaaaggcaacttcctgaccgaggatcaaatcctttggctgctgctggggatctgcagaggccttgaggccattcatgccaagggttatgcccacagagacttgaagcccaccaatatattgcttggagatgaggggcagccagttttaatggacttgggttccatgaatcaagcatgcatccatgtggagggctcccgccaggctctgaccctgcaggactgggcagcccagcggtgcaccatctcctaccgagccccagagctcttctctgtgcagagtcactgtgtcatcgatgagcggactgatgtctggtccctaggctgcgtgctatatgccatgatgtttggggaaggcccttatgacatggtgttccaaaagggtgacagtgtggcccttgctgtgcagaaccaactcagcatcccacaaagccccaggcattcttcagcattgcggcagctcctgaactcgatgatgaccgtggacccgcatcagcgtcctcacattcctctcctcctcagtcagctggaggcgctgcagcccccagctcctggccaacatactacccaaatctgaaaaagcagcatgttgagaagatggccccttgtgccttggaaagaggttcccatccctcattggaatcaccacccattccatccaggacttctcttacacttgggggtagcggggtcaggacaatcatctcagtcctgcatcttttcttctgctttcttccctccaagagcaaaacctgggcaaggggacttactgagtgggggtgggtgggggttgggaaaagggaaactggtgggatatggaacatggctctgagcaggactgttgagctcacatagtgttctgactccaaatctgggagcaggagaatgtgtaaacaagaataaagtggaagcaggttggtgtagaaaaaaaaaaaaaaaaaa

SEQ ID NO: 109 - DNA, 249 bp, Homo sapiens
tttcagagaaaacgaaatttatttcaagtcacataggaagtttaacacaatgttcttcctccaggggccaattcaaactttaaattactctctagactctgctgaaaatgaaggcaactctcttcagggcagggcagaactggatctgttgggtggttccaagtttcaggtgctatagatgaggggcaatgtgggtcttctggccttattttcctcattatcatcccaaaaaactcaaccagcatttgg

SEQ ID NO: 110 - DNA, 3614 bp, Homo sapiens
aaggagagaacttttcctgcacaaggaacgcctcgtggggagacccaaggcaggagcggtccggagccggctgcggcgtgtgcggccggccttgggacagcgatcgccgcgggtggcaacagagagccccaagcaaaagtgggagcaggagcttggaggtgagcacaggaagccccacttgaggcttttacgcagcctctagtctctgtttcttctggaataggcaagcgtcctttcaactctaagagaccagcagaggccactgtcccttaagactgccggagtcctcaccacttctccaggattccagaggagactgtggcgatggtgaatgaaggtcccaaccaggaagagagcgatgacacccctgcgccggagtccgcactccaagcggaccccagcgtctcggtccatcccagcgtctcggtccatcccagcgtctccatcaaccccagcgtctctgtccaccccagcagttcggcccaccccagtgccttagcccaacccagtggcttggctcaccccagtagctcgggccctgaggacctcagcgtgatcaaggtgagcaggcgccgttgggccgtggtcctggtgtttagctgctactccatgtgcaactcctttcagtggatccagtacggctccatcaataacatcttcatgcacttctacggtgtcagtgcctttgccattgactggctgtccatgtgctacatgctgacttacatccctctgctcctgccagtggcttggctgctggagaagttcggcctgcgcaccattgctctcactggctcggctctcaactgcctgggggcctgggtgaagctgggcagcctgaagccgcatctctttccggtcaccgtagtgggccagctcatctgctctgtggcccaggttttcatcctgggcatgccctcccgcatcgcttccgtctggttcggggctaatgaggtttcaacagcctgctcggtggctgtctttggcaatcagcttggaattgcgattgggttcttggtccctcctgttttggtacccaacattgaagaccgggacgagcttgcctaccacatcagcatcatgttctatataataggaggtgtggccactctcctcctcatccttgtcatcattgtgttcaaggagaaacctaaatatccccccagcagggcccaatccctgagctatgccttgacctctcctgatgcctcatacttaggttccatcgcccggctcttcaaaaatctcaactttgtgctgcttgtcatcacctatggtctgaatgctggtgctttttatgccttgtccactcttctgaatcgcatggtgatctggcactacccgggggaagaagtgaatgctggaagaattggcctgacgatcgtcattgcaggaatgcttggggctgtgatctcaggaatctggctggataggtccaaaacctacaaagagacaaccctggtagtctatatcatgacactggtgggcatggtggtgtacacgtttaccttgaacctgggacacctgtgggtagtgttcatcactgctggcacaatgggcttctttatgactggctatctcccactgggatttgagtttgctgtggagctcacgtacccagaatcagaaggcatctccttcggcctcctcaacatatctgcacaggtatttgggatcatctttaccatctcccagggccagattattgacaactatggaaccaagcctgggaacatcttcctgtgtgtgttccttactcttggagcagccctcactgcattcattaaggcagatctccggagacagaaagcaaacaaagaaactcttgagaacaaactccaagaggaggaggaggagagcaacaccagcaaagtgcccactgctgtgtcagaggatcatctctgagaggaaggtggtgacaactcagggaacacgaacaccccaccttttccttcagcacagctctcaccgccagcacaaagggcttcgctagagatgtttttggagggaatcagtgggactatttgtggcatggatggcctattcctcctagaacccacgtaagagcttggatgatttagttggagaaaattgcacctatcaccaaatgcaaatttgattcccacctccacccccttttaggttatgggagttggtgttgggacagggtggcagagaatattggagtcaatcctagcttggtctcttgccttccctcttttcctccatccatcgtggacaatgcctgcaaaattttcacaggaagaaagcctattcaggatattaacttgaaatttccagtgtcctaagagcctctcatgaagcccagttctaataagtggcaagctgctctgccggggtcatctcctgggtcatcggactgattgctcaagttctgcaggagaggaagcaccattagaacaactccatcagaacagctccaccgggacttgtgggcctaaattttcctggcctaacgggtctgtctccaaaccctctttcctaagagctgagcaaaccaaccataataaacttgacaaaagactttgttgtggccatgacagagataccgactcaggagggctacctacctaggtgtgatcatgctgggggctaccttctgagtatatttgtgaaagcacatatttgggaactctggtagcttgagttgggaatgggaaggttcttttttacagaagtacttccccagggacttctgtgtgtcacagtcacctctgatgcctttatcttgatgttgcattgggaatctcagccatcagcccaagtgcttgttttattccaaggcagggtaatccccgtcaacttactctaacctttgctgaaaactaatcttgattcattctactctgaaaatccaaaggtgcttctgagagataagagggaaggggtagaaggaaaggtgccccttgaaatgggaattgagcctgttagaattaaaagcttatctcacctctgctggggacagtatttgcaccaccaacccctctcctcacctgctttgagcgataatctttatcagatattctaaacttaaagggattccctttaaaccaactcaagctgatctttcctatctagcctgctgtttggctgtactcatgggctttggtaatatctcctaaaaatgaggttttggtaatttttcctatgcattgggcaactgtgatcgtgaccactgtgctgtcttgctccagccactgccctggcctcagcatatcagggcagcctgtgctggctgcaatactgtggtgcttgggccactgcctgagaggagccaggtttgtgtgtgtctgcatgtgtgtgtgtgtgtgtttgtacagattcaagcaatggatgcaaggaacatgctgtatgtaatagaagaaagaagtccacgttttcggcagaagtagtgagtcagtgtggaagagaggtgagggtgtgctttactttttgataaagagaaagatgtttactcataaacccttcaaaaggtattaacaaatgtttaccaaacctattgctttattttaaaaacataatttgtgttttctatttgtaagatctgacatttcgaggccaataaaaacttctcagaaaaaaaaaaaaaaaaa

SEQ ID NO: 111 - DNA, 3699 bp, Homo sapiens
agagccaatggaaaggggctgccgcgcggccgtaaagagtttgtagaggcagttcgggtgcggtacgttgcattccggtaccggacgccgagagcggtttgtctccgtctctggagttgtaggcgagaggtgatcatgtccggtcgcgggaaacagggcggcaaagtgcgagcaaaggccaaatcccgctcctcccgcgcgggcctgcagttcccggtgggccgagtgcacagactgctgcgcaaagggaactacgcggagcgagtgggcgccggggcgccggtgtacctggcggcggtgttggagtaccttacggcggagatcctggagctggctggcaacgccgcgcgtgacaacaagaagaccaggataattccccgccacctgcagctcgccatccgcaacgacgaggagttaaacaagctgctgggcaaagtgaccatcgctcagggcggcgtcctgcccaacatccaggccgtgctgctgcccaagaagacggagagtcagaagacgaagagcaaatgaccctgacgccgccctcagggagctggctcccccagcaaaggcccttttcatggtcgtcccgcaatgcttttgaatgtgctggatgtcatggagggccggtgacatctagcggggaggtgggcggcgagggtcccggcgggagccaataaagttggtgaaaatcgtttggtcgagagagctgtgtagtcgcggggacatgtcggatggccccaggggaggggggcgaccgggaaacccctggagcaggcactggtgggtgggcttgagccactctggacggctttagtccgcaggtcaccctcgaggcgtcaggggagggtggcctggaggtgggcagggtggaagccacctcgctgtcagtagggcaaaggggaggcagagtcggtgcggtgaggcctccttcggaattatttttacttccctttcacagagccttcgctctcctgccagtttgtgagcactcaggaccaagttctgggaagataccgtcggatcgagctgagctcggggcaggaagtgtctgcggccatatttttcaaaaagtggagtaactttccgtcttggaagggtggctctgatggcacgatgtcaacttgagattcttcctagcctagtagctgctgtgctttcatgctttggatatcagatatctttatatagcacttttatgttcatattttttttttaatgaaggaaacgttcaataagtgagtcatgaggttggaaattcgttcccctgacagtcatattgcataacattgcagcgcctttagtcgtgggttacatatgcttgagcttttaaagtgatgttgtcaagtttctagcttcataatgatcctgtcttcatcatatcatattcactttgagaatcggtttgactttgctttcaaacaaaacaaaaacctcttgcttttaggggttcttacccaacaaataacctgtttgaactctcttatattctcccactagcctgaagcaatgacctcattccagtaatgtctttgggagttgcattgcctaatggcacaatattgctttaataaacatgtaaggaaagataggaccaaatatgtaagtgcagggggaaacacatttcagaccaggaatccacattgaaaagttaacactagtaatcatcttctgcccttaattgacactcctatttatttcatcctcagcaaatttcatcctggctcacagaccccacaaaaaagatcccagtacagatttcacatctttggattcatctttcctgtgagtcggaattgaagtcttccccaaaaatatatgtatatattgtatgtcttcatccttggtagcggctggcccattttcccacatggactttattttgtccccagtatttattgaacagctgtctatgccaggctctgtacaaagtgataggagtagagctgtgaatgaggccaaccagatttccactctctcggagctcactttatttttattggttcctgaagacgggacaaggaacaaatacatacgttaatatgagagatcagcttctgttagtacttgtacctctctgctgtgtgtggatgaatgatggaattacttctcccatgttgccatttttgaggtgtacaaaggtcaggccgtacacacctctgttaggaggcaaattattgggcaggttcgagatgttctgctatttactctgtggttttgtcatatgtaaaagtcataacacctgttttaaggattgagattgttcatttactgtgtgccacatattagacaataaatggaaaaaagtaccatgttcaatgggggtatgggtttatccttataggttaaattataggtaaacattaataggactttttaaaaaatgcctcattgttagaactactactcacagttaccacttggggtcagtggaacaaaatgcatatatggttttgacatttgagtctaaatttcttaaagggatgaggcatctgagggattgttaccaaaatgatgaagaaataaggacaagggacatcaagacattcataagaaaaagcacctttgccttcccctgggaagattcacaggaatctgtccagctcttattacatgatgagcaacatagacaagatacgaggcattgtaactgccctgtcgccacccgcctctcccaccactacccaaaggattcttagcatcccctcacatactctgcctgcctcaacgttcagtcagcccctcaccatttttgtttttgagagttttttttttaacccgaatagtttacgggctgtttaaaatgcatactcctacaaaatcagctcagcccatgatccatgatgaacaaacagtagttcttgctgatgtgtgattatgaatttaaaaggccagtatttctttaagcataagaccatatggaaaaaggcctaagacaaaatctgatgggaactgaattccagtttttaatagagttataatccatagttttatttacacacaaacacacacacacacactctttcctgcagagataagcaagccgttcagtgtggctgtggcttggccaggatttgtttgatctttgtttttcctgcagggccagtcttgtctttgtgtccccgaggactggtctgtttagttgtgcctgcctggaatcaaaaggcttagtcaggccccataattggtgatgactggcatactatatgcaaacttcacaatgccccttccagtggttgaaaggtcgcataccatgctgtgtaagaactttagctctctgcaatgagacttaaattcagattcactctactccttattagttatctgatttttggaaacttaatctctttaaacctcagtttcatctctaaaatgggcataatagtttacctcatagagtttggggagaattgagtgaattaatgtgtgtgaggacactaagattcccatatagaaataggctcaatgaatagtagctgtttttatttctatgtaaagtgagtagcggtagttgatgggagctgttgaaacaggtaaacagcattctagcaatccttcgacttttgtgatagcaaaccataaaaacaattttagtggctgttttactaattaaaggacatccacaattcaatgtataacagaaaaagtaatgattaaagcttgtgaatctgaaaaaaaaaaaaaaaaaaaaaaaaaaaaaaaaaa

SEQ ID NO: 112 - DNA, 2418 bp, Homo sapiens
gggacccagacttgccgacctgtacgactctggccatggggaacagccactgtgtccctcaggcccccaggaggctccgggcctccttctccagaaagccctcgctgaagggaaacagagaggacagcgcgcggatgtcggccggcctgccgggccccgaggctgctcgaagcggggacgccgccgccaacaagctcttccactacatcccgggcacggacatcctggacctggagaaccagcgagaaaacctggagcagccattcctgagtgtgttcaagaaggggcggcggagggtgcctgtgaggaacctgggaaaagttgtgcattacgccaaggtccagcttcggttccagcacagccaggatgtcagcgactgctacctggagctattccccgcccacctgtacttccaggcccacggctcggaaggactcacatttcaggggctgttaccgctgacggagctgagtgtctgcccgctcgaggggtcccgagagcacgccttccagatcacaggcccactgcccgcacccctcctggtgctctgccccagccgggccgagctggaccgctggctttaccacctggagaagcagacggccctcctcggggggccgcggcgctgccactcggcacccccacagcgccgtctaacccggctgcggacggcgtcagggcacgaacccggcggcagtgctgtctgtgcctcgagggtcaagctgcagcacctgcccgcacaggagcagtgggaccggctcttggtcctgtacccaacgtccttggccattttctccgaggagctggacgggctttgcttcaagggggagctcccactccgtgccgtccacatcaacctggaggagaaggagaagcagatccgctccttcctgattgaaggccccctcatcaacaccatccgcgtggtgtgcgccagctacgaggactacggtcactggctgctgtgccttcgcgctgtcacccacagggagggggccccgccgctgcctggtgccgagagcttcccagggtcgcaggttatgggcagtggccgaggctcactctcctcaggcggacagaccagctgggactcggggtgcttggcgcccccctccacccgcaccagccactccctgcctgagtcctcagtgccatccaccgtgggctgctcctcccagcacacaccggaccaggccaactctgaccgtgccagcattggccgacggaggaccgagctgagacgcagtggcagcagccggtcacccgggagcaaggcccgggcagagggccgcggccctgtcaccccactgcacctggacctgacccagctgcacaggctgagcctggagagcagcccagatgcccctgaccacacttcggaaacatcacactcgcccctctatgccgacccctacacaccacccgccacctcccaccgcagggtcacagatgtccggggcctggaggagttcctcagtgccatgcagagtgcacctggacccacgccctcgagcccactcccctcggtgcctgtgtctgtgcctgcctctgaccctcgctcctgctcctccggccccgctggcccctacttgctctccaagaagggagccctgcagtccagagccgctcagagacaccggggctcagccaaggatggggggccgcagcccccagacgcccctcagcttgtctcctctgccagggaaggttcgcccgaaccctggctgcctctgacagatggtcggtcccccaggaggagccgggaccccggctacgaccacctctgggacgagactttgtcttcctcccaccagaagtgcccccagcttggagggcctgaggccagtggggggcttgtgcagtggatctgatggccgcggtgaggtgggttctcaggaccaccctcgccaagctccagggtacctgcccctctaacccacttcaaattacaagtcagggtctgaacccagtgtgatggggggagtctctggggccctgagttcagagcccgtccctcagctcctgttccttggtgccagcagctggggcagggaagggtgggaggggccccatccaaaggatgccctggccagcgaggctgggtcacaggtcagggaggtcctggccgtccacagggtcggccctcagctcagcccgccaggagtcagggaggagactcgctgggagtgggagggcagcacgggcgtgaaggtcggaggacagagaaaggtcagcagggtcagagtatgtgaggtcagagggcatgagggtcacaggtcagcaaggtgtgaggagcacaagccagggtgccccgaggaggagggtgggtgggtccttgtgtggcctggcgcgcgccacagggcagcacgggagacgttgacaccaccggacgagaaagaaaaaaaaaaaaaaaaaaaa

SEQ ID NO: 113 - DNA, 317 bp, Homo sapiens
  misc_feature (137)..(137): n is a, c, g, or t
  misc_feature (201)..(201): n is a, c, g, or t
  misc_feature (203)..(203): n is a, c, g, or t
  misc_feature (205)..(205): n is a, c, g, or t
  misc_feature (215)..(215): n is a, c, g, or t
  misc_feature (219)..(219): n is a, c, g, or t
  misc_feature (225)..(225): n is a, c, g, or t
  misc_feature (240)..(240): n is a, c, g, or t
  misc_feature (244)..(244): n is a, c, g, or t
  misc_feature (255)..(255): n is a, c, g, or t
  misc_feature (259)..(259): n is a, c, g, or t
  misc_feature (263)..(263): n is a, c, g, or t
  misc_feature (270)..(270): n is a, c, g, or t
  misc_feature (272)..(273): n is a, c, g, or t
  misc_feature (291)..(291): n is a, c, g, or t
  misc_feature (294)..(294): n is a, c, g, or t
  misc_feature (309)..(309): n is a, c, g, or t
atcctataaaaataagtttattgtgctggcaaagacaatgatagagcagaggtggcagactgttccccaagccaactgtttccaaaggagacctgagggactgggtgtgagttgacagtggtgggagctggaagcancaagggatgcggggacatctggggagcctggacctgaccttggagctcacttcacacaatcttnananaattaaattncccnccaagnaagattgggaggggncttnggaagggggtntttnttcncctgagntnntggatgagaggcgctgcnganaaaatttcctattanttaggcaa

SEQ ID NO: 114 - DNA, 332 bp, Homo sapiens
ttttaactatagtctacagtttatagtgaaaagcagaataaaattacaggtgaatcttgaaagaaagcaagttcaaaccacagagagtgatgccagagatctgggaccttctgggaaacatgccaggagcccactgaagggtttccatcagggaagtagtgggatcggactgggatatggtgaagctcttggtcatccaggagactctgcccatctcaagattcttaattacatctgtaaagatcctttttttatgccacaaggtaacattcacagatttcagggattaggacatggctttttccggggggaggcatttattcagcctccca

SEQ ID NO: 115 - DNA, 402 bp, Homo sapiens
  misc_feature (141)..(141): n is a, c, g, or t
  misc_feature (379)..(379): n is a, c, g, or t
  misc_feature (398)..(398): n is a, c, g, or t
acagccctgtgactgacagaaagggtgttttacttgtctattggagccattgagaggttctaaccagttgcaaggtgggtgaggaggaagcacagaagttgtgtggggtagaaaaagcctggggaaaatggtgcctttagncacccatcacgtgcctcaagttccaaagaatgtgaacagcaggaaaagagatttgccctctccccactgtcatacatgtgacagtagaaagctgaagatttgagccagaaactggctatgcaagattgattcaggttgattcccagggttctgttttatttccacccaggaaacaccagcattcttgaatccttttcagcattaggcaaaggagcagatgtgggcattctggcatctncaaggaggtctttgagcancacc

SEQ ID NO: 116 - DNA, 1868 bp, Homo sapiens
agtttcggaaccccagccagctcacctctgcgccgctgaacccgatccgagcctccggcaaaggtttttccctcctcccccggccgagggcttctgcagcccgggcacccccgccccgcggcgccccacattcccccagcccggggcccttggcgcgtgcgctccgtgcggctgtgctccgcgggactttgtttgtttcctcctcgtccctctttgttgggctgaacaccagcctcgtcaaagccccccactccggagggagttcggcttctccagcagggcggctgcagcgcgctgccccgaccccgcctgcggcccctcacgccgctagtgctcccaccccgccctcctggcaccccgcctgcgtccgttcgcccgaggaagccaaccgcgacttcattgatgcacccattccagtggtgtaacgggtgtttctgtggcctgggactggttagcaccaacaagtcctgctcgatgccacccatcagtttccaggaccttccgctcaacatctatatggtcatcttcggcacaggcatctttgtcttcatgctcagccttatcttctgctgctattttatcagcaaactgcggaaccaggcacagagtgagcgatacggatataaggaggtggtgcttaaaggtgatgccaagaagttacaattatatgggcagacctgcgcagtctgtctggaagacttcaaggggaaggatgagttaggcgtgctcccgtgccaacacgcctttcaccgcaagtgtctggtgaaatggctggaagttcgctgtgtctgccccatgtgtaacaagcccattgctagtccctcagaggccacgcagaacattgggattctattggatgagctggtgtgagtgctgccgctacaccgagacctggagaagacctcttgcctcatggatgtctggtccctctgcacagctccaaccaacaggactgtagggtgatgacgatcactttcccagtgatgagaagggtggtctaggactgggcttctaccctcagtgcaagaccagtgccagatgtgcccccacttcctgcctcctgaagccttcttccctgctactccatgctggtggcctcacccatcaagaccactgtctcctggtactggactatctacctgccttgtccctgttctgggggaaggtgtccaccccgatcaagaacatggagaaagtcctctttcaaggctcccattaggaggatgagctgccttgacccagaagggatgagacgggctcttacctctctacaaccttccctccccttcccactccttccggagtaaggttagaagggaaggaaggaaagatcaaggaaccaagcgcctccacgggaggcgagggaggctctgtatgaaacagaagagcagggacataaaggaaaatgtcagtgtttacatgggacctatggaaacaaaggctggcgggcgccagctgactccagagtaagagagggcccttcccctgccaggacccacggtgctatccattcagtctcttcctcagttaatctcggagcttcctattccatgttgaggtttgtgggcccctctagaggagggctagttctatacttaaattgattcccaggggccttttttttttttttttttttttttttgatcaaaaggggtgtggggatgggggtgtctacggttaagcaacagatacctccttccctttgtaaatagtatttttatacttcatcctcgcctctcaggctttagatacgaaatctccagaatggaagggggtggggattttctgttcctccctggagtgggtgagggtgggagaaagttacatatttaaagaaaaataaatttaataacaagtttctctaacct

SEQ ID NO: 117 - DNA, 1188 bp, Homo sapiens
atgactttggaccacaaatcccccaacttgccaagtaagccagaaactcttcagacgttccttaaggaagggggcgcggagacttgtgggaaacggagtctggaagttgatggatcgccccggcagggccccgggaaccggtctttggcagccccgtctgcgcatgtgcagacttcctccttgttccttactcctgtctctgatcagcgtggagcctccgcgtctacgcgtaactcagcgaccaggtgctgcactaacgatgcgctccgcagaaagcaagtgacggaggaggaggtccgctgcggatctgcaggtgccacgaagaagataagggcggagggaacaggtttcctgatcagaataaagggctccgggaaaaggcattcacatgttaaaagagctgtttccagaagctcctctaactcgcaggtgccctgggcaaccattcatcagctggtcaaacccactactccagcggggatgagaacaattcttacaaagtttactttatgctgtactatcattcctaccttagcaagccttattgcagatgcagagcctgagtttgaaacaattcccgattcttccgccctgaataactcatcatgtcggaggttgccaagaaccgtcggtcaacgaaggtgtgggccagctgtcacaggacagaggttaaatgaaggaagacatacaaagtacttagaacaagtcctgttatatagtaactactatacaagtattgtcagtattttttttttgagacggagtctcgcagtgttgcccgggcaacactatgaaggagagaaacactatgaatgtaatgaatttggaaaatttagcaagaaatcaaactttacccaacatcaaagaatgtacacaggagaaaaacctgatgagtgtaaagaaaatgagaaagccttgaagaagttataccatactcaaaatgagagaactcatgcaggagagaaagtctatgattgtaagaaatgtgggaaattctttcatgaaaaagcatgccttactcaacatcagagaacccacacaacaggaaaacccagcaagtgtaatgatagtgaaagagtcttgaaggaatcttgcctcactcccaatcagagaattaaaacaagattaaaacaagagagaaaaactgtaaaggtaataaatgtgagaaacctttctttgagaagttga

SEQ ID NO: 118 - DNA, 551 bp, Homo sapiens
gaacttttcactttcctgtcctttcaagcaacagaaatcaactagcaatcagagagtaacctacccatcctcttgggcaaaatttctttggttcatgaaatgctgcaaatattacacaattccatgtttcttctttttctaaagagggcagcaactgagtaggcattgaggttgagtgtaagaaaattctcccctactccataggtgctttcaggcatcatggctaatcagctagaggccacatttcccagtctcccttgaagcttgttgtggccatgtgatcagcttcttgtgaatgggagcttgagtagaacacatgactggttaactcttaaatcgtgctagacaaacctctccactgaagtactaatcaacttaaaatatcaacgtacccatggagccaaagcagcttggggagtcagaggaggtctcagggaaatagcgatgcttcaagagagttaaaggctataccagcctcttcccagagccacctttgcacaccttcatttgtgcacaaataaatctattatgattataaaaaaaaaaaaaaa

SEQ ID NO: 119 - DNA, 494 bp, Homo sapiens
atctgaagagctaacctgtctgtgaaaagggaattagataaaacacaggctaccagttcacagatgctagagagagcttgctgtcagcctagggggaattctcaccaactgaaaaattcctatcagtgttcaatgacatacgacattcatagagattctgaattgcccaaggagtttccaaattgtaattctaatccatgagttttgggcaatttagtggctttgtgataagaaaggggaaatgcaaaacttctcttgtaagactcgtggtgtgagctggtcctgaagttcttgatcattttgttagcacccaaactggtttgtcaacaaactttgagagtcaaaagcttgagagacatgcacatcaaagaccatgacaaaaagggaagaaaagcaacaacagcacagaagaccctctggccctctgcaggctgggttacagccttctcttcaccattgcatttagattatagccattgcaacagtacaatgat

SEQ ID NO: 120 - DNA, 543 bp, Homo sapiens
tatgtagacctggggtggaggtccaagaatgtgcattccttgcaaattcccaggtggtgatgctgcagagccacactttgagaatcactagtataatccagtatgctcttccagcatcacaccttccttcctgagaatcacaggagttgtgaacttgcagattagcattggggagaatttagatcaaactaatttgtagaatcaaggaggtcaagtaaggtcacaggggcacttgggttgagccagggttttagcccaggtcttctgacaactgcctcatgtccttaccacaaaggagctgctatcctttgcctttccccaaagagtgaagactgcttaaagctcaaggatctttcttgaatttgtgaaatttgttcaggcaaggtgaaaagcaaaaacctatggttcacattgactttttgtattgatcattgtcttttgaagacaggaagtatgatcagtctctgccacttgtgctagtttttgtgtggtgtttagaaacatgggcatttgtctggatcctaattacaaataagtaaccta

SEQ ID NO: 121 - DNA, 531 bp, Homo sapiens
ttttaacttaaaaaacatgtctatatttaatcattcaggttaacacagccatacaaactggtatttaagaaatctccccagttagcctatttttcatttttccatgtatttccaggagagatcaccacaagtaagtcagagtgcatgcattaaagtcaaaatgattggtgccttcaagaggaagatccctgaatcatgcaaggagcttcattcagaaagaagaccttcatctctaccttcagaatgttcttcactgcactggaatgaagatggtgatgataacgatggtcagggctcaagctcaggcccttccctgctgtgtgacataaatcagtgcccgaagagcaggaagcagcagagcccatgagggtggccgtctccagaacagatgctccccattcagccacacttggcctggatgtgcataccaggtgtgaggctattgattcaaatctgggttaaggaacccggcttctccagggctccatgtgaggactagcagggtgctgccatcaggtcaggaagtggctt

SEQ ID NO: 122 - DNA, 2990 bp, Homo sapiens
atggaagtgtgttaccagctgccggtactgcccctggacaggccggtcccccagcacgtcctcagccgccgaggagccatcagcttcagctccagctccgctctcttcggctgccccaatccccggcagctctctcagaggcgtggagctatttcctatgacagttctgatcagactgcattatacattcgtatgctaggagatgtacgtgtaaggagccgagcaggatttgaatcagaaagaagaggttctcacccatatattgattttcgtattttccactctcaatctgaaattgaagtgtctgtctctgcaaggaatatcagaaggctactaagtttccagcgatatcttagatcttcacgcttttttcgtggtactgcggtttcaaattccctaaacattttagatgatgattataatggacaagccaagtgtatgctggaaaaagttggaaattggaattttgatatctttctatttgatagactaacaaatggaaatagtctagtaagcttaacctttcatttatttagtcttcatggattaattgagtacttccatttagatatgatgaaacttcgtagatttttagttatgattcaagaagattaccacagtcaaaatccttaccataacgcagtccacgctgcggatgttactcaggccatgcactgttacttaaaggaacctaagcttgccaattctgtaactccttgggatatcttgctgagcttaattgcagctgccactcatgatctggatcatccaggtgttaatcaacctttccttattaaaactaaccattacttggcaactttatacaagaatacctcagtactggaaaatcaccactggagatctgcagtgggcttattgagagaatcaggcttattctcacatctgccattagaaagcaggcaacaaatggagacacagataggtgctctgatactagccacagacatcagtcgccagaatgagtatctgtctttgtttaggtcccatttggatagaggtgatttatgcctagaagacaccagacacagacatttggttttacagatggctttgaaatgtgctgatatttgtaacccatgtcggacgtgggaattaagcaagcagtggagtgaaaaagtaacggaggaattcttccatcaaggagatatagaaaaaaaatatcatttgggtgtgagtccactttgcgatcgtcacactgaatctattgccaacatccagattggtaactatacatatttagatatagctggttagaaaaatgccactgtttttatcaagaagggaaatatatttgaaatataaaatattaaaattatgctcatttctatttttaaaaataatttaagaaattttacccttgttttcccttgttatggctcttctaattctcatttaattttaggatgtaaaaagtatatttttgcagaacaggcagcagcaataacttgtttctgttcttatgtaaataagaatccattattcgctcatgtggaagcttcttttgcatcatttgggactgccatttaaaaaaggataggtaaacaaagaaatgacaaaaataaaataaataaaataaaaatggataggtggtgacccactgagcctgatcataatacgaagaccagcttctgccactgcctttccagactcttaccactgcctgttgattaaatctaactcttcaacatcctagacaggcccttataatcttgcttcaaatgctgtgcagccatcttgcctcaacttccctctcatttgcctacagcatctcgggacgcttctgtgtttcccaagtatacgctgttctttcgctctttgtgcttcgccagtgctttccatgtgcctcgtagagttatttttcttgaagaggcagctcaaatgtcaccttctccagaagctgctctccacttgctttaggcagagtcagtcacttttcttctagattccaaagtgcctgatccacttggttgtggattcctggagcctagcaccacaccagaagcacgaggcccttgagaactgtgtgttgagtgaactaataactgtattatagaaagcataatgaaaatgtcctgtgactgaagtatgtgtagcttgttgcaggagtcacaggaaagttgactaggattgagtgtgttgggctttgggtataaaggagggggattctacgggggcagtagctcaacaaggaatagagggaggagtgtaattttggtagctggtgttgaatagggcctttgagaatcagactgaacacagtgaaatatgtgcccaaagttcagaaagatgaagtttccagaaactaagaaggtagcacaatatgtggcatcatactcagaaaggaagaccatgccatggggccagaaattcagaaacgtaattcttacattgtgattgcaatggatactcatgaaagaaagtgggtagtggccgatttgccttcagagtgacaggtagagaagggaagagcgtgtagaactgtggccatactttaggagtgtgagggatgctgaatctcccagagagctcacactggccaggaatgctgagagtagcagatgcttttcttttgggaggatagtaaaacaatttagaaccagatatgctttgtcttgattctcaagtagaataatcttcaaatgcaaaagaatacattagaaatggacaaaagtggccaggagcggtagctcatacttgtaacccagcactttgggaagccgaggcgggctgatcgcttgaggtcaggagttcgagaccagcctggccaaaatagtgaaactcacgtttctactaaaaatacaaaaattagctgggtgtgatggccacttgggaggctgagataggagaatcgcttgaacctgggaggcagaggttgcagtgagccaatatcgtgccactgcattccagcctgggtgacagaatgaaactccatcactccatctcaaaaaaaaaaaaaaaaaaaaaaaaaa

SEQ ID NO: 123 - DNA, 632 bp, Homo sapiens
tggttcatggttgacacctaacaaaaagacagccaatcgataggttggtcagcaacttttctcataacctgacgcatacataaaagctgggttaaacgccatttctaccttggaaatttaaccaaagaaaggtcaagaaaaagcgaaaagactcgggaggatgctttgaaatgaaaagataagaattggagctacagtaggttgtaagaagccccggttgcaaaatattgaaactatgagcaagctgtagtgatggtggagagaagagtttcaggccaagggaaagaagcagctcagaggagactgagctaggccagtggacatggccccctaactcctgccacagagccctggagtctcctggagccagagtggctcctcagtcccagggcagtgaggcctatcccttccaatgcctcttccttccttctgtggaagaccaactccattgatgttccatgtttatctccctcctgagctaacctagctgagtctgctccttacaatcaagaaaacccacccactttactggattctctctgtgtgcagcgatggtggcatatatctttgtagctttttgcctctaatataatgcattataagggtaagtgatgagttctcagtaaatgaat

SEQ ID NO: 124 - DNA, 419 bp, Homo sapiens
ttcggcacgatggacaggaagaaagtggtggagtcagaggtcacaatccaaagcaaggtgacagtctcttgacgaagacaccctgagtgctgaattaaggggctaaataacagtgctatagtggtttcataatcataaagcattccaggaacacaatattgcttatcaactgagctttaaaacagatatgaggcaggacatggtggctcacacctgcactcccagcaatttggcaagccaagctttgatggctctggcagaaagccttcctgttccaaactcaccacttatcatcatagtacccgcgttcaggcattaagaagaaaagagcatccaatccctctgctttcctgcatcggctcccatgcacaagcaaatgtgttgtgttagtggctatcaaatattcatgtatttgatca

SEQ ID NO: 125 - DNA, 243 bp, Homo sapiens
aacagaggcaaagatatacaaaccaaaagcggaagaacttctttctcctctggatgtctgggagtaaccaggtaggtcaactcaagccagatgacaagtggagagaggtgacaagaggtgtgttggacagctcggagaggactgaagcatccaacctccttccaaagctacctgtactgatgcagccatacacttgcccttgggcaagagaagttcattacagcctgctccacaaaaagggga

SEQ ID NO: 126 - DNA, 575 bp, Homo sapiens
tggcaaccctaggtaggggtaaacaagtaccccagtagaagtatgactgaggttataggtatgtgtgtcaaggagagggcagattctacaatcacaaaggaagaggaatcagttttttcctggatagacgcagaagaggaaaagtctttgtggaaaaggtggtatttgaactgagtcttgaaaaatgagtttgtttgcacagggtggattatagggtggatgagaggcatggaacccgaactggttattgctgattgcctttatttcctctcacttctaaatgtacactgttcattgtggccatgtcctgtcctgcacggtgtggttctcagccctggacaggaatggagtggagaggtgagggcctcttccttgggctctccatctcagcctgaagactctgctagtcctatattctttagatttttatttgtttatttatttatttatttacttcttactagccagttcatcacagcttcaattccctgttacacttcaaaatgcttatgttgaactttccctgcctgctgactgtgtgatgtctctctcctgatggcatccagaatgacaca

SEQ ID NO: 127 - DNA, 306 bp, Homo sapiens
tttttttttttttttttaaagagattattttattcaggctattgcaatagagagaacactcatgagtgaggaacgctaaagagcaagtagggagtttggggttttatacaggtaggtaaacaagaaaatcatgaggatgcgtggaggcaggtcttacctatcgcatgtggaggaggatgattctttgctgttaatcacttcccagaatacaaaacagtggggagatttcttaactgtcactgtttcctgtgaggacagggctcacataaagtttaacattcccagttccgccttcagttcaaaaca

SEQ ID NO: 128 - DNA, 1112 bp, Homo sapiens
ttcctctttaaactctgatcctttgctctggagaagccaggcaccatggcatgaggcagccctgtggagaggttcatgtggtacaggaccaggcctgcagcatcacttgagagaggcaacataactcttttactgactatcacagataggaccacaaaacagccttgtaaactcatcctagaggatctaaaagagaaccccctcataacagaatggcattcccagcttgcaggctctgagactccattgagtcatgccacatgtatggaaaatgatttttggagtgttattctatctaaggaaaaacaaagcaaattttccactttcaagattaaaggacattctgtctacattaagacaagcaggtacaaagaagtaagttactgttggattaagaatatccaagacaatggtcacaacttgaaagcacatggaaaaacatgaattatttttataatgtcagctaatccacagctgtgccacctgttagtatggatgctatccaaaaggatttttgaaaccttgttatccaaatgcagaaatggcagctgaagagatgatttgtgacagcatttgctgagacgaagtctgtccactagatggataaaatcagttcccttttcatagcttgatcatctacatctgctagtgacccagtccctgagagtcaccaagaattgattccactgaggcgatggcaggcggggctttggtgttggaaaagtcagtggttgatatggacagcacagactcacataagctgctggtttattacactagaaaaataagggatcccttgacccagctcggcaagtgtgaaatcacgaaataaatgaaggttaacaaagactggtctaaggaatagttcactacaataccgcaatgctcttctcactaatactcgactctgcatttcggtacttatatctgaaagatttgcaaataatgacaacattcgtgccagacattactgcaagtgaggaacagactaaaggagaggaaggaacaaaatgccttccaagagagaaacattcattagccttactggcaagtgtctaaagcaaacaaggaaactgcaaaataattacttagttacaaataaacgcttttag

SEQ ID NO: 129 - DNA, 544 bp, Homo sapiens
gtaattcatgcatagggttttattatctagggaattttaaattaacaaggaacgcctcccaggttttccaaattaaaggcttcacatgatattttaacttatttgcttcccaaaatgtacatttaattttaattttcctttctagttttttctttctcataattatttaaaaaagaaaaacatgtttcttctaggcagaagaggtcccggtactctcctagaagaagctctatcattgtaataggattccttctttgagaatgaagaatggtgtccgactcttatatttcatctgccaatgtattaataggagtagctcttaggagatctttataccatcatgtaacattatccacatcagaaacacaacatctagcataaatttaatgcaccttttaaaaccacaatgttgaaatattcacaagctgtaaatgtgttcttggtctgtatgtgtaggtggagggaggcaaagttgtggtaataaagtgggaaggcccgggaagaacagctaactgtataggggtgaaatgacgctgttgatact

SEQ ID NO: 130 - DNA, 2232 bp, Homo sapiens
ggcgcgctttcaaacgctcaggtttcctaccttccggctgcttgggaacttctttcttgcccgccaagcccgcagccacccgggcgcggcgggactcctagacccggcgctgcgatgaagaggacccgcgacgaggtggatgcgacgctgcagatcgccaagctgaatgcggccgagctgctgccggcggtgcactgcctgggcttcggccctggggccagcggcgctgcagccggcgacttctgcctgctggagctggagcccacgctgtgccagcagctggaggatggacacagtcttgtgattcgtggtgataaagacgagcaagctgtgctgtgcagtaaagacaaaacatacgacttgaagatagcagacacttccaatatgttgcttttcattcctggttgtaaaactccggaccagttgaagaaggaagattcacactgtaacattattcacactgagatctttggtttttctaataattattgggaattaagaagacgtagacccaagttaaagaagctaaagaaacttttgatggaaaatccatatgaaggacctgacagtcaaaaagagaaggattcaaatagctcaaaatatacaactgaagatttgcttgatcaaattcaggcaagtgaggaagaaataatgacccaattacaagttctaaatgcctgtaagattggaggttattggaggattcttgaatttgattatgagatgaaacttctgaatcatgtaactcagcttgtggattctgaatcatggtcttttggtaaagttcctttgaacacatgccttcaggaactcggaccattggagccagaggaaatgatagaacactgtcttaaatgttatgggaagaaatatgtagatgaaggcgaagtttattttgagttggatgctgataaaatatgtagagcagcagcacgaatgctacttcagaatgcggtgaaattcaatctcgctgagtttcaagaagtgtggcagcagagtgttcctgaaggaatggtaactagtcttgatcagcttaagggtttagcgctggtggatagacactcgagaccagaaatcatatttttgctgaaagtagatgatttacctgaggataatcaggaacgttttaatagccttttctctctaagggagaagtggacagaagaagatattgctccatatattcaagatttgtgtggagagaagcaaaccataggtgcattactcactaaatattctcgttcttcgatgcaaaatggtgttaaagtttataattcgagaagacccatttcttaaaagaacaacagtcttttcttcaggactcaagttgctttataaagttgctggatacaagaaaaataacttgtacttttatttctgacttttagaaacctagtcttctaaggcatttttctcctcatcttaagcattttgaaactactgttatttcttaaatgttataggatgtagctttaaaattatatttgtactatgtacacagtgtaaacaaggacaaaagaattctttcctatattatgtctgaggtctctatgatttatttaaagtttggctttttatatttaaaatgtcatttctttacttaggatttgatgttctaatcattaatacacttaagttttccagagaactaaatagtaatagtttcatagaagagaactatttattcacttaaatatcatttctcaagtgagtgagttcccctctacttttagccttccacccaaactggaagcctctaggtgctatcaattatttatatccatcgtttacatccatgaaattggctgaataattactcctctgcctggcgtagacatgtgctttgggaaaaaaacgagtttataatcctataatgaagaatactggcacaggcaatgctcactcgaaaacttcaagtaatttctagttggttttggaatgcttgataaagttcctttacagctttattttcctgatttgttttggtttagatcaaagttcaaattaattttaacttagctaatgaactcatcaccaggacagttggagggggtaggccgaggttaaatggtccacgtttcaaaaatgttaatggctaatccataattaaagaaggtttaactgttactgaagtttacaagttttattgtcatgaacatgaaatacaaacacgatggcttcgaaatgtctttcaataaatgtttctgcatttaaaaaaaaaaaaaaaaaaaa

SEQ ID NO: 131 - DNA, 2299 bp, Homo sapiens
ctcttccccagccctccttgtgtgccctcgtgagtggcggtgacaatgctcccggatgtgggccccaaggccagcggccccagagctgcccgcccacccgtccgcctgctattgtctgctcaggcctggcggtgtggcgctgggcttgtggggccctggcgggcaggggactgtgggaacggattagaggtcctgggcttgctttcctcgtcttgcataaactcttgatcaaagacattcctgggatgacagagccctgtgagctgcgaggctggcccagagtgcgggacgcacaccccacgctgcagcccctgcacaggcctgcccttgctggccctcgctggccctggctgcagtgctgactttggggactagccttatggtgggactggtgatagagcgggtgccagcaggcaacacagccttccccaccagattcagaggccaggcccccaatgctgggcagagcgaggctgtgactgcttcctggggtgcttcaaggagggtcacgctgcatgcagggtagccggagggattgccggatgtatgccactgccactggacctggcttctctggactcccatgggcagtgcaccaccctctgcacagccctagccactgttatcccacaagcgcggtccgaagtccacgtgcccactctgcccagcctccttcctctgtcccctcagggcctttcactccttgtgacaactctaggtgctgtctgggctcctggggaacccccgacccttccagccatggaatcagctcccggcatgcgggtcaggctggacccatggctctgcacctcagcccagcagcttggggctgccctgtaggagccgacacgacctcccttccattcggcccccttcctaggacccactgtatgccagggtggggagacggaggcagagagaaatctgggagatttccgtcctggaggggctcagccagagcaggaaggtgcccaggcatgacaatcccagactcccagaaccacctgcctgctgtggggtggggaagccctcagagagcccatccttacagtcagagcagagatgaaggttcctgtggaccgaggcggtgggccaagcgcagaacaggaagctggatgcagtctggtgtgtcaggagctcctgggcaaagacatcgagcttattggggtcaaggctggggagagatggggctgagtcccagggaccttggacggagctgaagggagataggaaggctgggggttgggggcagaggatgaagaatggatgaggactgtctggctgcagggagatgggccaggaggcagggcaggtaggggtggcgggcgtgtgaggacaggcttctgcgaaggggctgcagggagagctgactgcggaaggctttgtctctgaagttcctcaaaggtcagtttttaccatcaccctctgggtagcgcagatactccaacaagggacgaggtctccactgaatcccaggaggggttgcaggcacagaggtgatgtcagtggagtttgagagttgggaacaagggcctagagtggccagacgatgcctttgatatggtttggctgtgtccccacccaaatctcatcttgaattgtagctcccataattcccacgtgttgtgggagggacccggtgggaggtgattgaatcatggggcagtttcccctatactgttcccatggtggtgaacaagtctcagcagatctgatggttttataggggtttcccctttcacttgagtctcattctctcttgcctgctgccatggaagacgggcctttcgccttccgccgtgatggtgaggcctcccagctacgtagaactcgccgcggtgcaaccagaaatgcacagacccagccgcccgccgcccagaccctcagacttgcgcgtcacaggacagactccgctgtgccccgtgcacttgccaccagcctttggcctctcgatacacacaacatccaggacttgtgcccttgccccatcacgacagacaaagcgtccctcaaggcccccgcgtggttcagacagacgccgcagccaggatggttgagcaaacaatgtgaaagagatacacagaagcgatgtgaatatttccaaaccgtgcctggaagtcaacggtagcagcgcaataagaaaatggagctgcggcctgtccccggtgtgggcaccgccccttcccctcgggagcctcctcctcacacctcctcccgcctgtcctccctcacacgtcagcctccacactcttgccacctcccttcaacacttcctaaataaaaattacaagaattacat

SEQ ID NO: 132 - DNA, 244 bp, Homo sapiens
ttgtcattggaacatctgcacgtgaaaatgtgttggtggtaaagggatgggaaacgtgtgttgccaaggagttcccagcacctgaaagaagcagaaagtgtgtggcaattaattgtcctataaaggttggaaattgtataaagcaaaaaaattaaagttaaaaaaattttaataattattttaaatacctgaacaagtccccagaataaaaacttatggttgtcttaagaaaaaaaaaaaaaaa

SEQ ID NO: 133 - DNA, 558 bp, Homo sapiens
aaatcctactgctcctctccagcagtgtaggccttctcaagtctccctgcacatgggtaggtgggtaaagcttggctgatcggcagggggatgaggagatggtgaacatcacgttgggaatcaacagacctgtgttcacatgttaaaacttgtgtgaccttgcggcctctgagcaagttcctgtgcctgtttctttcaacgaggataactacttccacctgcctttgtaatttgttcctgggacaaagaaagcctcttgaggaggctggcctgccctgcatatgttggataaacgcttgaaatatggacctgtccccatctctcgcctttccccggaattcaggactgaatggatgctgcctgcattttggggagtgggagttttgcttttcctttgctttgctacttactcactctgatgaacaaggaggagactgacagcttcacagtcctggatcatttcctgccctgttctcccatccagctcatggaagtcagcaactccatccactcattgcacagagaccagaaaggggaagggattttctcactgtctca

SEQ ID NO: 134 - DNA, 2288 bp, Homo sapiens
gcctgtcgcaggcgtgcagggacctggactccgcctcgtccccggggctcgggcagccgagccatggcggggaactgtggggcccgcggcgcgctgtcggcgcacacgctgctgttcgacctgccgcccgcgctgctcggagagctctgcgctgttctggacagctgcgacggcgcgctgggctggcgcggcctggcagagagactttcaagcagctggctggatgttcgtcatattgaaaagtatgtagaccaaggtaaaagtggaacaagagaattactttggtcctgggcacagaaaaacaagaccatcggtgaccttttacaggtcctccaggagatgggacatcgtcgagctattcatttaattacaaactatggagcagtgttgagtccttcagagaagagttatcaggaaggtggatttccaaatatattattcaaggaaacagccaatgtcaccgtggataatgttcttattcctgaacataatgaaaaaggagtactgcttaaatcttccatcagctttcaaaatatcatagaaggaactagaaatttccacaaagacttcctaattggagaaggagagatttttgaggtatacagagtggagattcaaaacctaacatatgctgtcaaattatttaaacaggagaaaaaaatgcagtgtaagaagcattggaagaggtttttatctgagcttgaagttttactactgtttcatcacccaaacatactagagttggctgcatattttacagagactgagaagttctgtctgatttatccatacatgagaaatggaacactttttgacagattgcagtgtgtaggtgacacggccccactcccttggcacattcgaatcggtatattaataggaatatccaaagccattcactacctgcacaacgttcaaccatgctcggtcatctgtggcagtatatcaagtgcaaacatccttttggatgatcagtttcaacccaaactaactgattttgccatggcacacttccggtcccacctagaacatcagagttgtaccataaatatgaccagcagcagcagtaaacatctgtggtacatgccagaagagtacatcagacaggggaaactttccattaaaacagatgtctacagctttggaattgtaataatggaagttctaacaggatgtagagtagtgttagatgatccaaaacatatccagctgcgggatctccttagagaattgatggagaagagaggcctggattcatgtctctcatttctagataagaaagtgcctccctgccctcggaatttctctgccaagctcttctgtttggcaggccggtgtgctgcaacgcgggcaaagttaagaccatcaatggatgaagttttaaatactcttgaaagtactcaagccagcttgtattttgctgaagatcctcccacatcactaaagtccttcaggtgtccttctcctctattcctggagaatgtaccaagtattccagtggaagatgatgaaagccagaataacaatttactaccttctgatgaaggcctgaggatagacagaatgactcagaaaactccttttgaatgcagccagtctgaggttatgtttctgagcttggacaaaaagccagagagcaagagaaatgaggaagcttgcaacatgcccagttcttcttgtgaagaaagttggttcccaaagtatatagttccatcccaggacttaaggccctataaggtaaatatagatccttcttcagaagctccagggcattcttgcaggagcaggccagtggagagcagctgttcctccaaattttcctgggatgaatatgaacagtacaaaaaagaataaattctaccagaagataaagaaaaaagcaagtattgcataggcacctgagcataggtatgaccttgggaagacattggctccataagcaatgccaagagaatgatcaatagtgagtttgggtgatgcagataaacaatctggataattccatttcttttttcccaaaccctcaaacagagtgccttaaaaaattgttttatcaggataattgtctcatgaccaaatccacgctcaattagagccattcaaaattccttaagatcatgggttctgacttcagccaaacaaaacaatcaaaacctaccaaaaagggactggattgtaatgtcctctccatcatcctcagtgtgagtcctcagagcctccatctgccaagaacattcagttggattccatcgtttggtttagcttgcttgcacgggttgtaggaaatg

SEQ ID NO: 135 - DNA, 490 bp, Homo sapiens
tatcttctgtctcatgctagcagtggaataggaaaaggactcaaaagacttctactggccataatgaagtacctgttactatatttgctttcctaccataagcaactataaaactggacaatatataggcaactgatctcatgcatttcaagcagcacaggattctgataattaacagaaggaaagcacatgaggataatactggaggctgccatgggagaagtctgcacaaaaagagcaagtttaagagcttcaggagtcataaatggcttgagaagattatgctagagattgaagcagatggaagattctagaaacagaaagcattcttttcattggtgtgagtcttgaatataaatggaaatcagaggtctgtaatagcaggccagtgtggataaggcagtaaggttttgagtctgaggagatggctgggggcagtttgtagacttattgtcagtccagtgtagaatttgagaatatagccagggct

SEQ ID NO: 136 - DNA, 485 bp, Homo sapiens
ataataagaaaaaaaaatcacagaatcatgtttacatagcacctctatagactcagtcataatctggatttctcatgtgtgtccagggatacatcatttaatcaagaaacactaagaacaaaatcttgcggagaaggatctcagtaactggtgggtaaccaggactggtttcacaagtgtaggacttatacagtaacaccagtaacacagtccccaagcacctctccccgacctgccccacatccctacttggtttaatgctctactgtgctaaaaaaattcttaatacattttgaacaaggagttctgcattttcattttgtatcaggcaataagtttgtagccagtcctgaggttaacaatgtaagacctggattacagacctctcctttctgggaaatcccttctgtctgggcaccttattactagttgcaatatttgtcagatgtttttcaaaagggaacataattaaaataaactgctac

SEQ ID NO: 137 - DNA, 879 bp, Homo sapiens
atgactccaaccctcagcgggaatcggacatgccctagccaggaaactgagcagtcagtgggattagatcaaaataaacaagcaaaattaaaaacactgatagtgaccgaagtagtagtctggtgtgtgggtgcagctgaagtttcagaagtgtcaggtgcaagagtagttggggaagaattaggtgtggtaattggggcagctgtggtctcttgtggagctggggaagacggtggagctggtgtagttgcagaaggtgtgggtggggcagctgtggtctctggtggagctgaggcggatgatgggtctagggtagttgcagaaggtgtgggtggggcagctgtggtctctggtggagctgaggaagatggtggagctggtgtagttgcaggaggtgtgggtggggcagctgtggtctctggtggagctgaggaagatggtggagcttgtgtagttgcagaaggtgtgggtggggcagctgtggtctctggtggagctgaggaagatggtggagctggtgtagttgcagaaggtgtgggtggggcagctgtggtgtcttgtggagctggggaattcactggtgctaatgtagctacagaagagcttgtgttaacattttctcttgaagatatggtggtggcattctggggaagaaaagtcacatttggaagggtagtaattttggtggaagctgatgggaaagtcacagatggaatttgggttgtagccactaaggtagggttgaccacactgctatttttatctggatgtttaggtggctggtgaggatttgggaatttgggggggttattaggtgaaggtggaagcttaggcctacagcgtttgtgcagacatttataggactttctaatgaacggc

SEQ ID NO: 138 - DNA, 1064 bp, Homo sapiens
atggcggtgggtggggctctgtcaactctcagtgcagctagggcacccgagccctgtggctccacatggggctcagacacgtgcacagcctacctaggcctgacccacaatccaggcacaaaaaagcttgtgggacacaaagccaagagcccttttaaaggtccttttgaaaatttcaatctgaccaagtggaacaaaagaaaaacatgtgagctccttgagggtaatccctctctccctggtagccctagtactgccttcaggcagatatccacaaaagcaccttgcacagaaacatctttgagctattttaagaggcagcattattttactgacaaatgttcagaattgagctctctgacttgcccccagcccaacctctatggattgaccattctcctcagagagactgtgtatgcctgtgcaggcacacatgttgaggggaagacaggaagacctaccctcccccaggccctggcttctcttcagacagtgccattcacactgagcctcacaggcaagtactgcctggtgtaacttggggagtgatggggcctgctgaccagaatcactcctccaaaagcttcacacacaagcctgagtttccagtcatcaccagcagcaccttcagtctttgagagccttcttaatgaacacacatattttacctggatcaagacactgtgttatctggcaaaggttgcccatttaaaatgagtgactggaaaggttcgtttatctggtcaaccctctactgcccccctattgtcacccctttgggattagaatcctgaaagaatgatgagaagaaaggctacatatggagagacctgagaaaccccgaatctttcttgagaggaggaaatcagacacctgcacagtccagcagcctgatcccaggagccagggagcagggagcagaggagagttccagggaccagaagccaggaagtgggattaaaggctaacactggccacacaagacggaccgctgcacaggaatttacagttcacagagcactttttcatctccttaaaatctcataaaatcgcagtgaattgag

SEQ ID NO: 139 - DNA, 349 bp, Homo sapiens
ttttttttgaactaaaaattatgtttatttttcataagcaagaaatttatatacttcccctggaagaataccatcattaatccgacagaggtttgcaaccagtgatttagaccaccataggtactgagctaaatttctgttagaagagggattgaacggagtggggtggtccaggtatcagcagcagtcagtcacttgtgagagaagcagtgagtgtcctgatgccaactcagcttgtgctgtgagtcttggctgcccatattagtttgctggggctgtcataacaaaatgccaccaactgagtggcataagcagcagaaattatctcacaattttggagtccaggagt

SEQ ID NO: 140 - DNA, 432 bp, Homo sapiens
cgagatctgcaccttcacaaatgcacattttcactgactccaaaaatttcattcaaactttggtctgtattgcctgacttcttagactagcttcttcattcttgttcaatgaaactgtgataacctaagcggtataggagagggagaggacagacttagggttgtgccttcgaacaagcacattcaacgacagcctcagttagaattcccagacgctgcctgtcttcctgggtcttgaaaaagtggggaaaaagtgtggttggcccactcagactgccagtgatgctgtggtgtgacgggtgtgtatctctatctcatacaatgggcgcaggtgacgaccaggacctgcgatcttcgtacgtttacagtccctgaaagccctcacctttaattagaagggaaaataaaagccatgtggcaaaaaaaaaaaaa

SEQ ID NO: 141 - DNA, 608 bp, Homo sapiens
gatctctgttattcagtgtcaataggtacaggaagtttatcttaatatgggcaaaactctgaattagaatacatgcaccacctaaacatattactcagcattaacctgcctaaacacttccagtgccactggcagtactagcacataattccagtagtgagaaatactttgtgaataagtcattttattttccttctggtgcatggtagttgaggagtggtatgggaaccaatttgtggtttggggtccatcttttaatctattaaattaagaggtaaatttgaggttttctttttcagtgggatctactctttgacaggtgtagtaaaggaaagctgctcatcctgttactctgaacttacaggcatctgcataagatgtaaatattttttgttcaattgtaatcccactataaggaaaatactgtcctatgaaaagaagtgctttggtttgttaaggctgtgtttacattgtggtcctgtacagcatagtatagagatgctagttgcacttttacatttttctaaaattgttaaaactccacttggtatattgtattaataaaagccaaatccagggaaaaaaaaaaaaaaaaaaagcctacagcc

SEQ ID NO: 142 - DNA, 571 bp, Homo sapiens
  misc_feature (38)..(38): n is a, c, g, or t
ccgcgtcctttttttttttttttttttttttttttaanttcacaatatcacaaatgttatattcacacaacagaacactatatacccatgacaaagacaaaactactgcttcatgcaacacactggatgaggctcacagacacaatattgtaccaaaaataaaagacacactcaaagggtacatatgtgtgattccacttatataaagttcaagacagacaaaattaattgatggtgctggaggtcaggacagtggttgcctctgagaggtatgagctaggaggggcacagagactacggggtgctggaaatggtctccaccttgatctgggtggaggttttgagtcgggcactggagttgtgtattcaatgtacagatgtgatacctcaataaaaaagaaaagaatgaatgaaataaaactaaacaaatcagcaatcacctcttagattctggtgagtaaaaacaatgcaagttgcagaaagacatggacagtataccatttatgttaatgttaaacataaagaacaatactatacataatatacatattttagggatacatacatctgt

SEQ ID NO: 143 - DNA, 416 bp, Homo sapiens
aatgataatatatagtttattttcaatttgggttatgcatctaggtgtcaaatgacaacaatttccttctgagctgaaaaataactacagcactgattgtctcagtccctgttcacccacataaaaacaggaatgtgatcctgagagagaagaatttaattgggtgagtcaataggtgtcaggtatcagcatgttggtggcagaatccagggctgcagtcctcatgtagctactaaataatcaagtattggttacttgaattaaaagtggaaactagtaggtgttggtaaaaatgtgttgagcttggctactcctgttttccaaaagcattttaggacacatatacgctgcagtatcccagaaatagaagtgtgggtaacttaacccaaagttgtggttcctgtgtccagcctgtg

SEQ ID NO: 144 - DNA, 1239 bp, Homo sapiens
atgcacaagaacagtgcgggcgaccacccctgggattgggggcccactcaaggaaagcgtggagggcagctggggaccagtgtgaagcacgatcctccgctgagcgcagcagtgtcctgcacaaggaagttttgtggagtaaggaagggagtcggcgagggtgactgtgtcctggggagggcattcagcagcagcattgctgtaaccgacaaagacaccttcgaattaagcacattcgttgattccagcaaagcactgcaccatgaccgagatgagcttcctgagcagcgaggtgttggtgggggcttgatgtccccccttgaccagtcaggtttggggactgaagaaagcctaggtctcttagatgactacctggaggtggccaagcacttcaaacctcatgggttctccagcgacaaggctaaggcagactcctccgagtggctggctgtggatgggttggtcagtgcctccaacgatggcaaggaggatgctttctttgggacagattggatgttggagaaaactgatctgaaggagttcgactttgatgccctgttgggtatagatgacctggaaaccatgccagacgagcttctggccacgttggatgactcgtgtgatctctttgcccccctagtccaggagactattaaggagcccccccagtccaggagactattaaggagccccccccagatggtgaacccgatttgccatctcccagaaagtttaacccgaccaggggtccagtcctccactccagattattcctttagtctagagctgggcagtgaagtggatatctttgaaggagctaggaagccagactccactgcttacatttccaagatccctcactgcacaaaggaggaagacgccccctcagataatgatagtggcatctgtatgagcccagagtcctatctgggctctccctctacctccaggggctctccgagtaggagcccgccatctccaggtgtcctctgtggctctgcctgccccaaaccttatgaccctcctggagagaagatggtagcagcacaagtaaagggaactaggtatcgccagaagaagagggtggagcaggaggtcctcactggtgagtgcaaagcggtggaaaagaagaacgaggctctgcaagagagggcggattccctggccgaggagatccagtacatgaaagattcgatagaagaggtctgcaaggcaagggggaagaaaagggtcctctag

SEQ ID NO: 145 - DNA, 522 bp, Homo sapiens
tttttaaaaaacataagtattttatttcagaaattgtctatggtaaaatgagaaagaagtcagaaaagaattggagagatgtcaaactactatataagtcattacagaatttttaaaaaggaaaggaaagggtggatgcaagtgatctggacagcaaggcaatctaaggaaggtttggcaagaccatcagacagtcctcaggccaaagttgccattagaggagttccctgtctcccaggacagggcttccctttagctccctactgtgcttagtcagtaaccaggagcagccagtgggaggtgtgtgtcagtgcaagtgaagccgtgagttcttgaacacagcatctgtggcccatggtccattatgctccctatctctcaagttccatatggcacattctcaggactgccaacacattcttaagcactacattatattgtccacaagtctaaagtagggggaaaggacaaagataaaccagagagaccagttcctgacactaagttctaagacaaagttta

SEQ ID NO: 146 - DNA, 1529 bp, Homo sapiens
caacttctgggcaaggcagaggtgggtttggctttttaaaaattttttcagcctgtcctcatggaactacatattcttttctaagaacttttcatcctaacctccctactcacatcttctaagtgtctctgctctggtgggaatgtgatggacaacacagagccatctcagaagcctctgtggccaccaccaggccggccagggtgcagggggccactccctgggcagccatagggttctcagcaaggtgcattcgtcgtccctgctgagaatctgatggggcagcatttttttttttaattaaatgcaagctgagtcatttcaacctgcaaccttcaggtaacaggagttacccaagctccaggaattatgattgtggggtaaacccattctcttgttttcttgcggttctattttataacgcactagaggagacagagacgtcattgcttcacccagggcaagaggacaaaggaggatgcatggaaatacaaacagcccttctcctccaggccataccgactgtccaactagcaacagacttcacctggttttggagcaatctgaatttggaatatgccagagaaaacttctatcaggcaagatggaagactcctaggataggtctctctcatggagggattggcacgatggtaagagtccagtggatggaaaaggcctcctccttaaagatggtgatggaaacgagcactgcacagggaaacacaaatcaggtcccctgaaatccagcccaacctggccagaccctccagtgcccatcagggcttatgaacagggtgcttcagtgtctttgttaggggtggttaaaaaggagcacgtgcttataggggatgctgctgagctccatgattttgacttcctgtctaacctgttgatgctacaaaactcttttaaaaacagttaccatgggaacttttccctagcaagcattcttcaagaaacgttacaggtgctggtgaattcaatgcccttggtgtcaataagcttttgctgagtcttagaatgtgtggcttgaactgagaggactttcaaacagataatgcgaagtttccaatgcaaatgtcttcggggttaagtgtcagtgaagtgcagtggaaggtagggggataaaatgatctcagtgtatatggaggccccacttaagcattcaaaaaattctatatacagtgttttcaatgtattatgtatcagcaaaacaaaataccccatagggctataatcagctcagggggtcacctcagcaagagatgctctggctatcactcctactacgggatttcctctctcatcagaaccagtaggtggtcaaaaccacaataatgcataaatgaaggcagggaattgggtatccaatgtgagcaactgaaaaggtgccatgtattagctatttgccattatggttctgcaagtgctcagatgactcataaaatgaccagaacaaaaaaaaaaaaaaaaaaaaaaaaaaaaaaaaaaaaaaaaaaaaaaaaaaaaaaaaaaaaaaaaaaaaa

SEQ ID NO: 147 - DNA, 635 bp, Homo sapiens
gaacgggtgatgcggttggcgtgtgtgacccacaaatcattcagaggcagcagagccagcctggagatccgggctgtgacttcaggacaggagaccctctctctgcacaggttattatcctaaactgccaaaggtcactgtgtgaagcaattttactaagagccaccaaacccctctcttccctccaaccaagttcattcacccttctcagaagagcccaagagacctctgtgagagtaagacaggagttggcgatggtgcaacttgcagaacgccatgtttgttagcgccttgtcttcatgtggccggagggcactcctgaagcttcaaactcctgtaaaaacgcttcctgtccagggagggtggtatgggaagtctgaggtggctgggagaggaactggcgaagtaaggagttggagcaggagtcagagagacatgggatggggaaactcacaagcagactccagcccagtcagggaacctcactcaccgttccattaagggctggaaaaggaggaccgacaggtgtctcacagaagcgatggtagctgtcaggaggctgacccaggaaacaggcataaatcgggaggtgttgacctaattttctcagtcagcaaaccttttaagagctaatc

SEQ ID NO: 148 - DNA, 425 bp, Homo sapiens
  misc_feature (191)..(191): n is a, c, g, or t
gcgtcgacttttttttttttttttgacttattagaaataaaaatatacttctctctacatttccattgaaacatattctgaagcgccataatgtgaataccagttgtttaagtaagtttacattttattaaattaatgctaacacagctactatcatttgcctgctcacacagcaacaggggtggggtggnagttgaagctagatatctcacacacggaataatcattaagaaacaaccactgttgagcaaagttgataggcagtaaggaaataaagtggacataaacacagcagtactaattcataggcagtagaatattatattagaaatggaaggtgttttaaaattatatactttatttcttataaccactttcttaactgcatctacaaaacttgaactcatttatttacacaattaaaa

SEQ ID NO: 149 - DNA, 710 bp, Homo sapiens
gggtcaggaagaaaaagatctagctacgataatagacattctttacagatgcaaattttccccccacaaaaaacagctttgtgcagggccttttcaaaatatggcaaagaaacatgttttggggtaaaatatttttattttcttccttgtctcataacgttatgccagccagagtcaggctggaaagtaagtcacaatatatagggttaaatgaaacctatctgatgagaatttatgatttgtagggcatgactctccagaccccttagataggaatttgggcaagataaaaaaaatcagagtttagtcctcaccacagtgtcaacttgctaatgtgatggaatggcagcaagatttcaaagaagattttgggggagagagcagggagtggctcagggaaagaagtggagtgttgagtcagttggcttaatgggaacctggtttgcccattttgaaaaccacaacggagaaataatcacccagatctactattttttcaccttaaaacatcctggggcccgtcatcttgcaccctggctctgcagggcaggattggaaggtctctggggggccccgctcctctgaaggatcacctgccccacctgtcacattcctccctggccaggcctcacactaaagagactcgcctggctccaccaacacccactccagactctgtaggggggtatcagcagaaattgaatctttag

SEQ ID NO: 150 - DNA, 1211 bp, Homo sapiens
ctgggctccgtgccgctctgtttgccaaccgtccagtcccgcctaccagtgccgggcgctccccacccctcccccggctcccccggtgtccgccatggccaaagcctacgaccacctcttcaagttgctgctgatcggggactcgggggtgggcaagacttgtctgatcattcgctttgcagaggacaacttcaacaacacttacatctccaccatcggaattgatttcaagatccgcactgtggatatagaggggaagaagatcaaactacaagtctgggacacggctggccaagagcggttcaagacaataactactgcctactaccgtggagccatgggcattatcctagtatacgacatcacggatgagaaatctttcgagaatattcagaactggatgaaaagcatcaaggagaatgcctcggctggggtggagcgcctcttgctggggaacaaatgtgacatggaggccaagaggaaggtgcagaaggagcaggccgataagttggctcgagagcatggaatccgatttttcgaaactagtgctaaatccagtatgaatgtggatgaggcttttagttccctggcccgggacatcttgctcaagtcaggaggccggagatcaggaaacggcaacaagcctcccagtactgacctgaaaacttgtgacaagaagaacaccaacaagtgctccctgggctgaggaccctttcttgcctccccaccccggaagctgaacctgagggagacaacggcagagggagtgagcaggggagaaatagcagaggggcttggagggtcacataggtagatggtaaagagaatgaggagaaaaaggagaaaagggaaaagcagaaaggaaaaaaaggaagagagaggaagggagaagggagaggaatgaattgaggaagtgaaagaaggcaaggaggtaggaagagagggaggaggaaaggaaggagagatgcctcaggcttcagaccttacctgggttttcagggcaaacataaatgtaaatacactgatttattctgttactagatcaggttttagggtcctgcaaaaggctagctcggcactacactagggaatttgctcctgttctgtcacttgtcatggtctttcttggtattaaaggccaccatttgcacaaaaaaaaaaaaaaaaaaaaaaaaaaaaaaaaaaaaaaaaaaaaaaaaaaaaaaaaaaaa

SEQ ID NO: 151 - DNA, 3028 bp, Homo sapiens
ggattgagctgaccacaggccacaccagactcctctctgctcctgaggaagacagggcagcccggcgccacccgctcggccctcacgaagatgctccctggagcctggctgctctggacctccctcctgctcctggccaggcctgcccagccctgtcccatgggttgtgactgcttcgtccaggaggtgttctgctcagatgaggagcttgccaccgtcccgctggacatcccgccatatacgaaaaacatcatctttgtggagacctcgttcaccacattggaaaccagagcttttggcagtaaccccaacttgaccaaggtggtcttcctcaacactcagctctgccagtttaggccggatgcctttggggggctgcccaggctggaggacctggaggtcacaggcagtagcttcttgaacctcagcaccaacatcttctccaacctgacctcgctgggcaagctcaccctcaacttcaacatgctggaggctctgcccgagggtcttttccagcacctggctgccctggagtccctccacctgcaggggaaccagctccaggccctgcccaggaggctcttccagcctctgacccatctgaagacactcaacctggcccagaacctcctggcccagctcccggaggagctgttccacccactcaccagcctgcagaccctgaagctgagcaacaacgcgctctctggtctcccccagggtgtgtttggcaaactgggcagcctgcaggagctcttcctggacagcaacaacatctcggagctgccccctcaggtgttctcccagctcttctgcctagagaggctgtggctgcaacgcaacgccatcacgcacctgccgctctccatctttgcctccctgggtaatctgacctttctgagcttgcagtggaacatgcttcgggtcctgcctgccggcctctttgcccacaccccatgcctggttggcctgtctctgacccataaccagctggagactgtcgctgagggcacctttgcccacctgtccaacctgcgttccctcatgctctcatacaatgccattacccacctcccagctggcatcttcagagacctggaggagttggtcaaactctacctgggcagcaacaaccttacggcgctgcacccagccctcttccagaacctgtccaagctggagctgctcagcctctccaagaaccagctgaccacacttccggagggcatcttcgacaccaactacaacctgttcaacctggccctgcacggtaacccctggcagtgcgactgccacctggcctacctcttcaactggctgcagcagtacaccgatcggctcctgaacatccagacctactgcgctggccctgcctacctcaaaggccaggtggtgcccgccttgaatgagaagcagctggtgtgtcccgtcacccgggaccacttgggcttccaggtcacgtggccggacgaaagcaaggcagggggcagctgggatctggctgtgcaggaaagggcagcccggagccagtgcacctacagcaaccccgagggcaccgtggtgctcgcctgtgaccaggcccagtgtcgctggctgaacgtccagctctctcctcggcagggctccctgggactgcagtacaatgctagtcaggagtgggacctgaggtcgagctgcggttctctgcggctcaccgtgtctatcgaggctcgggcagcagggccctagtagcagcgcatacaggagctggggaagggggcctctggggcctgaccaggcgacaggtaggggcggaggggagctgagtctccgaagccttggcttttcacatgcaagggacagggttacatccccaaggtgagggggtggagtctggtctgctccactaaccagggtctcctcctcctcttccttcatcgcttctcctggagtgtgcggcctaacaaggccatccttatgccttgcaaagcaccctcaaaagctgcaccacagcctggagaataaaatatcctcagccctgatgcctccccattatgtaacacccaaccgctctcacctacaccctgaggtctattcactgcatcccagtgatacaaagtggaggccactgccttctgacatctggctcaaaagcccagtgtctgtttccatttatttccctggaatttcatttaaaattggtatagagaaaaaaaggatgtgacagaagcagagatgaccagaaagcacaggggcagggttctgactggcgtgtgggagaccctgtggccggcacccacctccacacgaggactaagctctgatttttttatcttgcccaaattcctacctaaggggtctagggagtcgcgccttacaaatcataaattctcatcagatgggttttatttgaccctgtatatcatgacttatttttaatctgactatggcataacattacaagacgaggcaaaaatatttaacccccaaatatatttccttgccctaccttgaacttgccctgcagagtctcttgtgaggagaatccacatcctataaagaagcccctttcccctttgttttccttcctttctttccagtccaggagatcatcaactaagagccaggcaccccttttaagtcgataagaaacagtttacaacctgctctctctctctctgaagtctgctgagagcttcccctgcacaataaaacttggcctccacaatcctttatcttaacctgaacattcctttccattgatcccaggtcttcagctaagctcaaccaattgtcaaccagaaaatgtttaaatttacctacagcctggaagcacccacccccgctgcttcgagttgtcctgcctttctgaactcaaccaatgtatttcttaaatgtatttgattgatgcctcattcctccctaaaatgtataaaaccaagctgtacctcgaccaccttgggcacatgttcccaggccctcctgaggtctgtgtcacgggccatggccactcatatttggctcagaataaatctcttcaaatatttta

SEQ ID NO: 152 - DNA, 2291 bp, Homo sapiens
aaataagggagtccggcggctcctctatcaggaagattgtgcatgccgtgggtctgacggcttgagtagcgctagggagaatccctgcaggtaatatttgacttttgcttcatattaatctgagtggaaaataaaagggccctcttctcctctcgcttccctgccgggcaggcgccatggcggaagcctcggcgacgggcgcctgcggagaggcgatggcagcggcggaaggctcctcgggcccggcgggcttgactctgggccggagcttctcgaactaccggcccttcgagccccaggcgttgggcctcagcccgagctggcggctgacgggcttctccggcatgaagggctgaggctgcaaggtcccgcaggaggcgctgctcaaactcctggcgggactgacgcggccggacgtgcggcccccgctgggccggggcctggtgggtggccaggaagaggcgtcccaggaagccggcctgccggcaggagcgggccccagccccacctttccagccctgggcatcgggatggactcctgcgtcatccccctgaggcacgggggcctgtcactggtgcagaccacggacttcttttaccccttggtagaagatccctacatgatggggcgcatagcttgtgccaacgtgctgagtgacctctacgccatggggattactgagtgtgacaacatgttgatgttactcagcgtcagccagagtatgagtgaggaggaacgcgaaaaggtaacgccactcatggtcaaaggctttcgggatgcggctgaggaaggagggacggcagtgaccggtgggcaaacggtggtcaacccttggattataatcggtggagttgccactgtagtatgccaaccaaatgagttcataatgccggacagcgccgtcgttggggacgtgctggtgttaaccaaaccgttaggaacccaggttgctgtcaatgcccaccaatggctggataatcctgaaagatggaataaagtaaagatggtggtctccagagaagaggtggagctggcctatcaggaagccatgttcaatatggctaccctcaacagaactgctgcaggtttaatgcacacatttaatgcccatgcggccacagatatcacaggctttggcattctaggacactcccagaaccttgcaaaacaacaaagaaatgaagtgtcctttgttattcataatctgccaataattgccaagatggctgccgtcagcaaggccagtggacggtttgggcttcttcaaggaacctcagctgaaacctctgggggattactgatttgtctgccaagagaacaggcggctcgcttttgttctgaaatcaaatcctccaagtacggagagggtcaccaagcgtggatcgttggcattgtggaaaagggaaaccgaacggcccggatcattgacaagccgcgagttattgaagtcctgcctcgtggggccacagctgctgttcttgctcctgacagttcaaatgcctcctctgagcctagctcgtgagatgaaagaacagaagttgtttggaccttagagccattgtccacaatcacggatggttctcaagagttgattgtaagaaatttccaaagaaggctgcctgcatagtggttccggctgccctttctaggtgattggaatcagcccatctaaagcagtctttatatgcattccgaggccagagtaacattttgaactttggggggatatttgttcatcacttgggtagaagaggagcaaaaatacctctgttttctcttgccaaagtaagatgaagctattccaggttgagggatttttctttgcacggggttgattaatttctgcacagggagtgagattattaaagtaacacacacacaaagtaaattgcaaaatgaaaaaaattagaagcaaatgagttttggaccaatattgttgataaatctaaattgttaagagagatcttataatgcaacatcaaattctttattcaattttactgaagtactggctctttcctgctctggacaagaattgagcaacttgtctgatgactgggaaaggaggacctgcaaccatctgacttggtctctgttaatgacgtctctccctctaaaccccattaaggactgggagaggcagagcaagcctcagagcccaggcctcagtggtcattaagatgttaagtcttttgcggcagattcctggtgatttgatcaataaagagtaatttcttgctaaataaataaaagaaaccttgttgaaaaactaaaaaaaaaaaaaaaaaaa

SEQ ID NO: 153 - DNA, 1817 bp, Homo sapiens
cattcgtgtcccctaaatctataaataataatataataaacaaaatacaagccctgaattggaaatgggagatggataccaaggcttgagtcctcagaacttagcttttcttggcctttacctctggagcaagagcccagctggtgcttttctttgctgttgcttctcagttccctctcctcaccctgggtggggtctctctcaggggtgttcattgcccgtataccttagtacttggcctagtgatcaaagcaccagtcctgggttccatgtctcatcaccagatggggctggtgaccgccccacatggtgctgtgagagttaaatggggagtatgtgtagtgcacttagcatagtagattgcaccagacatatcttccaacagtagctattgttattcactagtggagagtagaatgaggccctggggagggtgagagcagttctctaagaagtgtggaagtctaaaccgcagatgtggccaggaggaccctcccaatccacacactggcctccctgccccttcctgtatcagtgccaactttgtcctgtgcatcaaaaccctgactccatttcatgggttgctactgctcatttggctgcgggaaggccccgcttctgaaaataaaattgcctgtcagagaaaccctaaggatcaggattccggatctgggcagggcatggacaagttgggtggcagtggcaaaagcccctccccatggtctgccttttcccccagaagcaagttgctgggactgttgcataaaatggctcccacctccagtgcccagacagcctgcgctggggtgaagctggctacacgtgcactgaagctggcaggcttggggagaggtgagctgaggccaggtatctgcttcctttgcccaggattttgatggtctctcccctacacccacagtgggtgtgaacaacaaagacccaatctttgatggtggtgaggattcctctgcacacgctcacactcacgttctctacccccttcttttcaacgtggcccacagcacgattccagaccctgctctattgtgctcagaggaagcagctgctggctccagcccgaatttgggagtgctttgatatgcagccctctctggggccctgccagtactgactctagatgagccctctgcggctgctgggctcacaaatcagccttctcaccccttcctccaggagcagtgttggatgagaatctcccccttacacacatagatcctgtgtttgttttgtctgcttttgtttgtttgtttgtttttgttttcctgttctgttcaattttataaggaggcatagcttttggacttggttgcagggttgggtttggaacttaataataccttggattgacaaaggcgccttttcttctaaagaacacaaaccttgatggttcttgcctgggtgtggttctcacctgggtgagcctggctgtgagggtagggggcctgaggtcaccccaaccacagcttctgtggtcctactggcagcatgttctagacagacctgtgtggagctggggaaaggagagtggagaagtttgaggaagctgcatgtttatgttttgtgttcctccctcccccaggttggggtcagcgggactttatttggatccaccacaggtcttttcaaccaaagccttgcagaaacaggctttaccccatacacacagaagagcaacgacttccttgttaagagtctgaaaatctgggtgagagcctgtcagacccatggcctcagagagcaggaaaaatcctttgcaactgggaaggaaattcagaagacaaaaaaaaaaaaaaaaa

SEQ ID NO: 154 - DNA, 4731 bp, Homo sapiens
tgtatgtaggctgggagtgtctgctgatcacttggagtgctgtcccttggaacaggaggagtaagattgagcacccctgcagtggaccatgagtcggtaatgcccactgaggacctctgggagccatgtcagacgaatctgcctcagggagcgatccagacctggacccggacgtggagctggaggatgcggaagaggaggaggaggaggaggaggtggcagtggaggagtgtgacagggatgatgaagaagacctgctggatgacccatccctggaaggcatgtgtggcactgagcatgcccagttgggagaagatgggcagcagccgccgcggtgcacttcaactacctcatctcagtctgagccttcagagcagcttaggcgccaccaaggcaagaacctagcctccgaggaccccaaaaagaagagagctcagaagccctcccacatgagaagaaacatacgaaagctactccgggaggatcaattggagcctgttaccaaagcagcacagcaagaagagttggaaagaaggaagcgcctggagcagcagaggaaagattatgcagcccctattcctactgttccgctggagttcctccctgaggaaattgctttaagggcaagtgacggtccccaactgcctcctcgggtcttggcccaggaagtcatttgtttggacagtagcagtggcagtgaggatgaaaaaagcagtcgagatgaggtgattgaactgagctctggagaggaggacactctgcacattgtggacagcagtgaatctgtcagtgaagatgatgaggaagaagagaagggtggcacccatgtcaatgatgtcttaaaccagcgtgacgcccttgggcgggtccttgtcaacctaaaccaccctccagaggaggaaaatgtcttccttgccccacagttggcacgggctgtgaaacctcatcagattggcgggatccggttcctttacgataacctagtggagtctctggagaggtttaagaccagcagtggctttggctgtattctggcccacagcatgggtctggggaaaactttgcaagtgatctctttcatcgacgtcctcttccgccacacgccagccaaaacagtccttgccattgtgccggttaatactcttcagaattggctggcagagttcaacatgtggcttccacctcctgaagccctcccggctgacaacaagcctgaagaagtccagcctcggttctttaaagttcacatcttgaatgatgagcacaagacgatggcatctcgtgctaaagtgatggctgattgggtgtcagagggtggcgtgctgctgatggggtacgagatgtacagactcctcactctgaagaaatcatttgccacaggtagaccgaagaaaaccaagaagcgttctcacccagtcatcattgatctagatgaggaagatcggcagcaggagtttcggagagagtttgagaaggctttatgccgccctggccctgatgtagtaatctgtgatgagggacaccgcatcaaaaactgccaggccagcacctcacaggctctgaagaatatccgctctcgccgccgggtggtgctgactgggtaccctctgcaaaacaacctcattgagtactggtgcatggtggactttgtgcgcccagacttccttggcacccggcaggagttcagcaacatgtttgaacgccctatcctgaatgggcaatgtattgacagcacacctcaggacgtccgcctcatgcggtaccggagccatgtcctgcacagtcttctggagggctttgtgcagaggagaggccacactgtgctgaagattcatctccctgccaaggaagaaaatgtgatccttgtgcggctctccaagatccagcgagatttgtatacacagttcatggatcgcttccgggactgtggtagcagcggttggctggggctgaacccccttaaggcattctgtgtgtgttgcaagatctggaatcaccctgatgtgctgtatgaagcccttcagaaggagagcttggccaatgagcaggacctagacgtggaagaacttggctctgcagggaccagtgcccgctgtccaccacagggaacaaaaggcaagggagaggatagcaccttggcttcctcgatgggagaggcaaccaatagcaagttcctacagggcgttggcttcaaccctttccaggagcgaggcaacaacattgtcacatatgaatgggccaaggaccttctgactaattaccagactggagtcctagaaaactctcccaagatggtactgcttttccacctgattgaggaaagtgtgaagcttggggacaagatccttgtgtttagccagagtctttccaccttggctctcatcgaggaattccttggaaaacgagaagtaccctgtccacctggtaccgaggggcaaggagcacagaagtgggttcgaaacatcagctacttccggctagatggtagcacccctgcctttgagagggagcggcttattaatcagttcaatgatcccagcaacctcaccacctggctgttccttctctctacaagggccggatgcttgggtgtgaatctgattggtgccaaccgagtggtggtgtttgatgcttcctggaacccttgccatgatgcccaggcagtatgtcgggtataccgttatggccagaaaaagccctgttacatctatcgccttgtggctgattacactctagaaaagaagatctatgaccgtcagatttccaagcagggcatgtcagatcgggtggtggatgatctaaatccaatgctgaacttcacacggaaagaggtggaaaacctactgcactttgttgagaaggagccagctccccaagtttccttgaacgtaaaggggatcaaggagtcagtcctgcaactggcctgtctgaagtaccctcacctcatcaccaaggagcctttcgagcatgagtcattgctcttgaaccgaaaggatcacaagctaaccaaggctgagaaaaaagcagcaaagaaaagctatgaggaagacaaacgcacatcagtcccctatacccgcccatcgtatgcgcagtattaccctgccagcgatcagagcctgaccagcatccccgccttcagccagagaaactggcagccaactttgaagggtgatgaaaagcctgtggccagtgttcgtcctgtgcagtccacccccatccccatgatgccccggcatgtcccattgggaggaagtgtaagctctgcctccagcacaaatccatccatgaactttcccatcaactacttgcagcgtgcaggagtccttgtgcagaaggtggtcaccacgacagatattgttattcctggactcaacagctccacagatgtacaggcaagaattaatgctggtgagagcatccacatcatccgtgggacaaaagggacgtacatccgtaccagtgatggacggatctttgctgtccgggcaactggcaaaccaaaggttcctgaagatggtcggatggctgcctcaggttcccagggaccttcttgcgagtccacaagcaacggcagacacagtgcctcatcacccaaagcccccgaccctgaggggctggccaggcccgtctctcctgacagcccagagatcatcagtgagcttcagcagtatgcagatgtggctgctgcccgggaatcccgtcagagctccccaagcaccaatgccgccctgcctggccccccggcccaacttatggacagcagtgctgttcccgggacagctctcggaactgagcctcgactagggggtcattgcctcaatagttccctcttggtgactggccagccctgtggtgacaggcacccagtgctggacttaaggggccacaagcgaaagttggccacaccacctgctgcccaggagtcatcccgccggcggtccaggaagggtcatctgccagcccccgtgcagccgtatgaacacgggtatccagtctctggcgggtttgccatgccacccgtctccttaaaccataacctcaccacccccttcacctcccaggctggggagaactccctgtttatgggcagtaccccctcctactaccagctgtccaatttgctggcagatgcccgcctggtgtttccagtgactactgaccctctggtgccagcaggccccgtcagttcctcttccacggctacctcagtcactgccagcaacccctccttcatgctcaacccttctgtgccagggatactacccagctattcactcccattctcacagccactcctgtccgagccgaggatgtttgcgccttttccttcccctgtcttgcccagcaacctttcgcggggcatgtctatctatccaggctacatgtccccacatgcaggctacccagctggtggcctcctacggtcccaggtgcctccatttgactctcatgaggttgccgaggttgggttcagctccaatgatgatgaggataaagacgatgatgtgatagaggtcactgggaaatagctagggagcccctccccacctcacttggggcccccagcaggttgcccaccaagctggaaggcagtgatttagaccttttgagaataggacacttggcaggagggaaaaggaagaggacaaaggagggtggttggccaaagtggcagagctctgttgctgtttaacaaaagaggcaaaaaaaaaaaaaaaaaaaaaaaaaaaa

SEQ ID NO: 155 - DNA, 2367 bp, Homo sapiens
aaggtgccacagcaacccccaaatcttgggagagggtctttgggggctttggactttgatcacactgaaactccaagtgaacgtgacttttctacagtcactactcatttttcctgttcatctcccacttgattatgggcaacttaatttatcttagtgccgcagtggacactggcaagtagtagacagtcaatgaatacggacagaagaaaggaagggaggatgggaaggaaaggagagagggaagggatagagggagagaggagcttagtgtgttgaaagcatgtgtacagaaacaaatgaaacaaaaatcaaatgaacagcaggacccggctcaagagacagccgaaatgccagaaaattgtgtggaatctctgaagaatgcaatgggctcagctcaatggtgaagaggtctcctatgtcccttgtggccaagacaaaccaggcaaacctgaggctggacacacagaacagatatttttctcctctttttcttgcatctccaaaatttctaacttcctcttgtatgaaggcacctagacttagtgagtttccctttgtgacttggaagttgtgggaagggagaatcagtcaggaaatgaggtgtcagtaggctctttagcaaactcagccagtagatggctaaaaaaggacttggttactttgggtccattttgtctatccatgggatatgaccatgagcgcggggaagagctctctacctgagcatgtggactgaaaagagtagaaccttgggggatcctgaaggaagaggggaaaccaggaaaacagaggaagttaacttaggaggggtaagggaagaagaatgcaagattgacgttgcagaagccagaggccagggctaagaacagggtaagggacttttgagaaaggagtagcagagcattcacattagataagttctgaaaggtgtccactgagcctgggtttgttatctagaaggtgacctactgtaaactttgccagagcattttcagtggtgaagaagtgagacctttggctcccagtgaagggagcaagcccagttaggtttctttaacaagcttggccaggaagatggagcagttgctagagacgatggaaggtcaagggagacctttgcttcctccacaactgtggcaggctctggggcaccttcataagctgcacaaagagagcctgatgagagagggtgagaacgcagaagggaaaggaaacactgggcagaaaacagggtcttgggccaagaaaaggggagagggggacatttgcagagcatcggtagtgggattgccttgaacttgagtttgagtgtaaacaaagttcaccagaggggatggggaggagacagacacagaattagacccattcataggcttaggggaccttgcatggcccttttgagggcttcgttttcctcagtgaggtggaaggcaaagccaacttcctgaggcatgaagtggggatgggatggggatttggtaagactggtaactgtttggaatagctgtggtgggatatgggtgagggttattacgggatgctgtgatcccgggagaggctggaggccctgtgtatgactttctcaagcagtgttcagcagcgcaggtgtaggagcattggagagggagaaggtttggacctgtccaagatcggtaatagcgctggtgggcctgaaatagaaggggccaggtaattgaggatctcaccaagaatggaaaagggtctcactctgggtccttctgaaataaaaagggaagccacaaaaagggagattggctgggaagtatggagggaagtataggatcaatgagcctgaagacctgttgtaaggtgaggaaagaaataagagttggacggttaatgagaggtagccaggtcttggaatctgacatttccaagacagtgctatgatagggagtggcaaggtctacacagagagtatggctgttggaggaatagagttgtgaatttttcggcagacctttactgggcttgcttattgttcaattcagtactgtaactacagttctctaaatcttgatggagtaatctacatccccaagaaattatgataatgaaggttagggcactcaaaactatttttcttccctagcatttagggattctgagtatgagtctctgtctttctctcttcctttccttttatgatactgaataattacaagaagacagttacagaaagttatagaccttgaacatatgcaagtacttccctctaccttcattattagattcttgcccagctaggcaggtccaagattttgtttctggctatgctaattttggacaataaaaagaatatcctataagcaaaagcaccatctttcaaaaaaaaaaaaaaaa

SEQ ID NO: 156 - DNA, 2619 bp, Homo sapiens
gcttcctgggcttcccatctctggcgggaagcgctccccgacgcattctctacctaggggacacccccaaggcaggagcccgggccgacggagaggacttaacgacactatcggaccctctgggaaaagaggggagacgtcgtgacccaggccccgccccaccttgccgcctcgtgcccggcgctaagacccagcgggcgcgccgcccgcccggggcccggccctgtccccttccgtccgcggggcagccagctcagctccggagagccggcggcgcggcgggcatggctcgggtggcgtgggggctgctgtggttgctgctgggcagcgccggggcgcagtacgagaagtacagcttccggggcttcccgcccgaggacctgatgccgctggccgcggcgtacgggcacgctctggagcagtacgagggagagagctggcgcgagagcgcgcgctacctggaggcggcgctgcggctgcaccggctcctgcgcgacagcgaggccttctgccacgccaactgcagcggccccgcgcccgcggccaagcccgatcccgacggcggccgcgcagacgagtgggcctgcgagctgcggctcttcggccgcgtcctggagcgagccgcctgcctgcggcgctgcaagcggacgctgcccgccttccaggtgccctacccgccgcggcagctgctgcgtgacttccagagccgcctgccctaccagtacctgcactacgcgctgttcaaggctaaccggctggagaaggcggtggcggcggcctacaccttcctccagaggaacccgaagcacgagctgaccgccaagtatctcaactactatcaggggatgctggacgtcgccgacgagtccctcacggacctagaggcccagccctacgaggccgtgttcctccgggctgtgaagctctacaacagcggggatttccgcagcagcacggaggacatggagcgggccttgtcagagtacctggcagtctttgcccggtgcctggccggctgtgaaggggcccatgagcaggtggacttcaaggacttctacccggccatagcagatctctttgcagagtccctgcagtgcaaggtggactgtgaggccaatttgacccccaatgtgggtggctacttcgtggacaagttcgtggccaccatgtaccactacctgcagtttgcctactataagttgaatgatgtgcgccaggctgcccgcagcgccgccagctacatgctcttcgaccccaaggacagcgtcatgcagcagaacctggtgtattaccggttccaccgggctcgctggggcctggaagaggaggacttccagccccgggaggaggccatgctctaccacaaccagaccgccgagctgcgggagctgctggagttcacccacatgtacctgcagtcagatgatgagatggagctggaggagacagaaccgcccctggagcctgaggatgccctatctgacgccgagtttgagggggagggtgactacgaggagggcatgtatgctgactggtggcaggagccggatgccaagggtgacgaggccgaggctgagccagagcctgaactcgcatgagaaggggacaccccacaccgctcaagcttgggaagcctggtgccgatggccccaccctcaccagcctgggcagcagcaagaactatttattaaaaacttaagatgggccaggtgcggtggctcacacctgtaatcccagcattttgggaggccaaggtgggtggatcacttgaggccaggagttcaagaccagcctggccaacatgatgagacctccgtctctactaaaatacataaattagccgggtgtggtggcaggcgcctgaaatcccagctactcaagaggctgaggcaggagaatcgcttgaacctgggaggcaaaggttgcagtgaactgagattgcgccaccgcactccagcctgggcgacagagcgagactccatctttaaaaaaaaacaagacgggccggcacggtggctcacgcctgtaatcccagcactgagaggccgatcacttgaggtcaggagttcaagaccagcctggccaacatggtgaaaccccatctctactaaaaaatacaaaaattagccaggcatggtggcacacacctgtaatcgtagctgaggcaggagaatcgcctgaacccaggaggcggagcttgcagtgagccgagatcgtgccactgcactccagcctgggcgacagagtgagactccatctcaaaaaaaaaaaaaaaaacttaagatggacacagctgactggacccccatcctgcctcacccatgggtgctgcaccccagacccatcctgccacttctatgtctctggaccacaggatggtggtggcattgcaggttggcaagtgggctgatggggtccgccctcctcactgctgagctcctcacctggacagtctcctggacaaggagtttccagctgctggctggagtctcaggccaaattgcagagggtcctccagggtcctgaagagcactggactaagagtctagtggttccagggccctgaccagtaggtgctcaataaatgtttgttgttgaatgaaaaaaaaaaaaaaaaaa

SEQ ID NO: 157 - DNA, 473 bp, Homo sapiens
ttttttattaactgcacttcacttttatttttgcagaaatgcaaataaatcatcaaccctttgtgttggagccttctgcctgttgtgtcagcctcatttcctccacaggaagacacaccgtggcaccggggagcctgggcaggcctcaggaatcagtatctcaaatgagtgtgcataatttgtgaagctgagatgccagaggaaccatcttcaggattgcttcatcagtcccaacatacagagcctgaaactaggttaatgaattccagcagggccactggatgtcaacagcatgcacctagttgtgatgacaaaaaaaaaaaatgtctccagacatcaacaaatgtctccaaggggcaaactcacccacagttgagaactgctaacctagaaaatagtggttctgctgcaaaagtggtcagagaggcgtggagatggggaagtctgggaaggaggatgtgggagactgtttg

SEQ ID NO: 158 - DNA, 482 bp, Homo sapiens
catttttttttttttttttttttttttcaaagccaccaaaacacttctatttaattgctaccaccaatacagaatagaattaaggcagtataatacatttccacttatcctcacaagctttcatacagtaaactttgcttaaagtgtctatttgaatcagcaattgaaatttttattaaacagcagttttcttgaattgtagagaaaaatcatttcctggtctgtcaagtgtgctaataaaaaacatctacgacttaacatcgtgtatcactgaaccttagccaagtgtggtgggattggctgatgtcggatgtgtggtaggattgattggtgtaggcatctctttcttctccatgcccccctccccatccgggaggaatgctcatttacaacctcccagcagtattcaattcgcttcttgctgccatttattacttcaaattcccttttgaatgaaagcaataatgcaaaaaaaaaaaaaa

SEQ ID NO: 159 - DNA, 173 bp, Homo sapiens
ataacttttttttttttttttctcataatcctacttcattccttcattcacttatttttaaaagggtcatgtgtacaaatacatagttcagaaaaattttaaatataactataaaagtatacggcaaaatcccattcacagtcttattctccttccacagccaaacactttta

SEQ ID NO: 160 - DNA, 636 bp, Homo sapiens
atggaagtgattttgcactgtggttttaatttatatttcctggatgacaaaaaaagagaagaagtcttcagacaatcaaattattccgtgctatgggaggacattcaaacccaaggcaaagaagttgaaaactttgaaaaaaatttagaagaatgtataactagaataaccaatacagagaaaagcctcaggagccgatgcgatcaactggaagaaagggtatcagcgatggaagacgaaatgaatgaaatgaagcaagaagggaagtttagagaaaaaagaataaaaaggaatgagagtcttcagaaaaatgccatcaatgctattgtaaccaactcagttcataccatggagaagacgacaaggagacaacagggaatgagaaagctggaaagggcgaggcaagcacagggaactaagaagcagccgccgccagatgggagggcactcaggatatggagcctagagttttttaagaaaggtgatgtggtcagttatgcaaatgcctctgagtttgaacagaaggaccaaacaagtggcatcaggctgtgcaatgtgacatcattcataaccatgtcgagagcagatgtcctggagccgcaggaactgacgccccagagcagtgcactgtggtga

SEQ ID NO: 161 - DNA, 751 bp, Homo sapiens
atgagacttaagtttctgccttgaagagttgtatatccgttagtaacttaaactgtaattggcaggtatcacttgtgattctggaaattctgaggaacacagattccttaagtaatgaaattagtatctgtgggtatcattaactaaggtcacctttcaagaactgttaatgtcctttgtccccaagtttgacagatttgatgtcagaggcatgtgggcctctgtgaaggtgctgagagaatgggaaactaaggccattctaagtgataccagattacgttaaaaaccctcatcaagttcccaatttaccaagctatgcctcattaactgagggttttctgctgtatttggttccacacatgcaatttatatggcatttaatctgagagacccatctgcctcagtggcccatttcccttttatttttggttgctaagaaatgttttgtatctcctttgttccgggtagtctgtgctgttctaaatccttacaagcacttcagatttcgtacattggggttcggagtaagatcaaaaggactagctggttggtgtgaggaagaatgtctgggacctggcccattataatagtatatctggacttagattttgaactctaaagcatatgtacagttggaatggaacacttgtagaagtaacacaggtctatatatcaatggttactgcagctgtggtttctagatggtataggctgccccaatatgaacagggcataaagcgcaccatcactg

SEQ ID NO: 162 - DNA, 463 bp, Homo sapiens
ttttttttttttttcatttaacaagtatttattggtactattctaggcactggggattcagcaatgaacaagatagacaacgttccttctttcatgcttacatttttaaatgggtgttagggataggtaaggccataataagacaattcagactgtgataggtgctatggagaaaacaggttgatggtggtgaggtgtgagaggtcagggaagccctctgtgacatgaactgagacttaagggaagaaaaataagcagccatgcagaaatcagtgggaagattccaaacatctgtgataagtgatttttttaacacactaaatttacaaatccaaaagttcttcctccaaagtagtcatgagctacaggcttgttttctgcttccattaccaaaaacatttcttggagcttatttggaaatgctttgagaatatgctgcacatctttggaatgagttgtgaaa

SEQ ID NO: 163 - DNA, 540 bp, Homo sapiens
  misc_feature (29)..(29): n is a, c, g, or t
  misc_feature (36)..(36): n is a, c, g, or t
  misc_feature (54)..(54): n is a, c, g, or t
ccgctaagaaacgagactgtcatgtttgnaaaacanaagtgaacaatccctggnagattagtgaaggtcattgatggaagctccaggagagagtggggataatggaaggaataaagttatccacatctcatcttaaagctagcatctttaatacagtataaccaagatgattcctgaaggaatactccacctgaactcaagagtagttgcttaccaagaagaagcagttcaattgttcctaaaacatataatttgtctatctgtatagttcgacttttagataaggattataattttcaaatattaactattttccatttatgtatctagaaggaacagctgaactaatataaaagcatatgttttgtggacattgtcacataatagtttgcctatccactacagctcaaattcccaggaaaagattgtttcagttttcaaccattaactttatcttccatgcctatgtatcttagcatctccaaatcttaagcaaagagagaaaattaaaaaggatgtaagttgtcaaaaaaaaaaaaa

SEQ ID NO: 164 - DNA, 1318 bp, Homo sapiens
aactacaacgtccggctttctgagttgggtggcgggaaaggcgatgagtaaaggccgggcagaagctgcggcgggagccgccgggatcctcctgaggtacctgcaggagcagaaccggccctacagctcccaggatgtgttcgggaacctacagcgggaacacggactgggcaaggcggtggtggtgaagacgctggagcagctggcgcaacaaggcaagatcaaagagaagatgtacggcaagcagaagatctattttgcggatcaggaccagtttgacatggtgagtgatgctgaccttcaagtcctagatggcaaaatcgtggccctcactgctaaggtgcagagcttgcagcagagctgccgctacatggaggctgagatgcagaaagaaatccaggagttaaagaaggaatgcgctggctacagagagagattgaagaacattaaagcagctaccaatcatgtgactccagaagagaaagagcaggtgtacagagagaggcagaagtactgtaaggagtggaggaagaggaagaggatggctacagagctgtctgatgcaatacttgaaggataccccaagagcaagaagcagttctttgaggaagttgggatagagacggatgaagattacaacgtcacactcccagacccctgaggggcccacggtcaggactggtggggactgcaggatgtcagaagagtgagatgtcttgcactggctaccttgtttttggttggcttttgttgttgttcctgctactttcacctttaagcagagcagtcaggagacaagcataaaccagagcactgggtagagaggatgagggctggtggctgggggtagacccagcccatttcattgtctaaattgcagtagcttgaggttaacatttagacttggaacaatgctaaaggaaagcatttggcaatatttattataatttaattttatataaaaatatttaatttcctctggatagtcaaacctgccagatatcaaacctgaggaaggcagaagtgaatttggagaactagggtagagagaggttgctataaaacgagcatttggagggcccacggcttcactcaggacctgctgggcttgtgtaccccaggagcccttttaagtatcttttgtacgcttttcaccccacccccaagtcctgggagaaatgcaggcaacactgagacatgggagaggccaagatatgcttgacagaaagggtgattttgaggctcagttaatatttcaaaattgtaaccgtagcaaaactgcattggtatttagaaaaataaaaaatttccaatatgt

SEQ ID NO: 165 - DNA, 1015 bp, Homo sapiens
atgctcttgagcgcctgggtggagacatgcagaaggggtgggaagagcaggactctcggtgcccaatgtttctggatggccctgggcatctggggagtggaccacaaaggcagatcccaggggccacttagtgccagcccacagtcctcaccttcacaggtagaagtgggacaggcctttttgacctggcaaatccagccagagactgattctgagcagcagttctgcccggcactgactcactggccctgccatgcccacgccactgctcccgctgctgcttcgattgctgctgtcctgcctgctgctgcctgctgcccgcctggcccgccaatacctcctgcccctgctgcgccgattggcccgccgcctgggctcccaggacatgcgagaggctttgctgggctgtctgctgttcattctcagccagcgacactcgccagacgctggggaggcctcaagagtggaccgcctggagaggagggagaggttaggcccccaaaagtgaggccacaagtcctggcagcagctgtatccacaaaatgctttcttttggagtaggataatcctggcaccagcactgaccgaagcctgcccagtggacagaagatatagtgagggttgtgcatgagagggatctgccacagacatgcctctccactcccaacagaaatgtctttctggaagaatgccttgcatctagcacaaaactgattattgcccctctgtcctccagcagttcctcccaaagaccactcctaatcacctctggcctcaggcgggaggggaactaacacccacccacccctgccctccctgcaaatgggaacatcaaggttcccagtgcttaactgagggacaagtgacaatttagcagagaggcaagatttgaatccagactgtcttccagactcaggacctaccttaaaataatatctgagttgcttatggaggcagacctgcctgcaaagcccagcactcagcaagtgctcaataaatatttgatttgaattct

SEQ ID NO: 166 - DNA, 1026 bp, Homo sapiens
gctgccttccctgtggcatcatgaagtttcgcgccaagatcaccggcaaaggctgtctagagctgttcattcacgtcagcggcaccgtcgcgaggctagcgaaggtctgcgtgctccgcgtgcgccctgacagcctgtgcttcggccccgcgggttccggcggcctccacgaggccaggctgtggtgcgaggtgcggcagggggccttccagcagtttcgcatggaaggtgtctcggaagatctcgatgagatccacctggagctgacggcggagcacctgtcccgggcggcgagaagcgcagcgggcgcgtcctccctgaagctgcagctgacccacaagcgccgcccctccctcacggtggcggtggagctggtctcgtccctgggccgcgctcgcagcgtggtgcacgatctgcccgtgcgggtgcttcccaggagagtgtggcgggactgcctgccgcccagcctgcgcgcctccgacgcgagcatccgcctgccgcgctggaggacgctgaggagcatcgtggagaggatggcgaacgtgggcagtcacgtgctggtggaagcaaacctcagtggcaggatgaccctgagtatagagacggaggtggtgtccattcaaagttattttaaaaatcttggaaaccctccccagtcggctgtgggtgtgcctgaaaacagagacctggagagcatggtgcaagtgcgggtggacaatcggaagcttctgcagtttttggagggacagcaaatacatcctacgacggccctgtgcaatatttgggacaatactcttcttcagcttgttttggttcaagaagatgtctctcttcagtatttcattcctgccttgtaaaaattcagccagcttagattttttttttaaggttttgatcttttcaaaactaaaacagaccctgagttaattgggttgaaaatttggaccttcactgacttatgcagggcgtatattttgttgagcccttcctcctttgcaaaatttatattaaagcattggtaaaaca

SEQ ID NO: 167 - DNA, 637 bp, Homo sapiens
atgtactctctggtggatgaggagtttggaactctggctaaatcccttcccacacttgccacagtgatagggcttctctccagtgtggactctgagatggatgcgaagatccgagctctggctgaaacccttcccacactcatagcattggtaaggcttctctcctgtgtggatgcaccggtgaatgtgaaggttcgagctctgactgaagcccttcccacactcaccacacttgtagggcctctctcctgtgtgtactcgctggtggatgtgcagcactgggatgagtatggaatagcttggaatgactttcaatttctagttaagaggagaagcttctcgggatggatttcggttgcccaagacgccttccccgacctcattctcaggagcctggctcgttcctgcggtgcgggagctcagatgcaagctcttttcagcgaaggcagtgctgcggacagaaacctcagtctcttacaggagcccccgtccgtcgcctaacgtccaccgaaaacccccctgcaataacgcccgtcacaggcgaggaaaaggccggcgtggccaaccacgaagcccccagccggcccaggccagagctcggccaggagggaggaggggccatcggaggcgcggccgc

SEQ ID NO: 168 - DNA, 414 bp, Homo sapiens
atgagtttacctaagtgtgtgtgcaaaagcccagttgcaaatggcaatgatgcattacagtactccatccatctgttccaagagactgaaagctttctcttcctggcagatggctgggatcctgatacctacatgcatgagaagccacaccagaatgccagccgacatttgcatgcagagacgttgcctgtggagctgtctccagaagaggatgcagctgcaggcctcaagagaggagatttacataatcgtcgtggaagagtcagagaaaacaaaatggacaagaggaattgttcctgccacatgagggcctcacagctgaactgcaataaatcagctcagcagccactgagtccttttatggtctctcgtagaactaagatccaagataactacgctaagcctagctcctaa

SEQ ID NO: 169 - DNA, 998 bp, Homo sapiens
agtgtggaaacgcccactgaggggcacacagtgaggcggccactggctctgtgtccttggggaagccccttctgcggtcccctccattgtctgcgtgacaaagtggacgtagaactcccccatttcctgcccagggcgggtgaggaccctgcacacacacggtgtgtttgtgagctgtgcagagtggggtctccctggcaatggccacagcctccaggggcgctgacacctcccgtctaactggtagacagtttctgcctcttcttgtttggggattggagagggaagtgcgtctggatgactactaagatgaggaggctgaggcctagtgctcctagcgggcttggtcaagagcaggaggcggaggtggtggaaggctgtttccctgcggtgacagaaactccatttgcaccagcttacattaaaaaaagaggagggagaatatggtcgagtgaccccaggagtgatggggagcactgacggagtttctccctgctctggatagcagatccgctggctcccagcttatgatccatgaagagaacgtcttccccttgggcttcaatttgaagaatcctgaagacgaccctgatggcctttcgcggtccacgtgccccttcttgcactaccgtgatggtcctatccacggacgccttctcttgggttctgtggttggatgcggaggaatcatcgatcctctgtagtggaagggaagggaggacacaccaagaccatgtggccccaagagccgtgagaggaacagaagcctgactggtgcctcttacatgtcactgcagcctcggggggggccaccaggaaaacacctgacatcctgttctctagtaatggtgtggctggaatcattcctgtaccaaataattcacccatttaaagtgtgcaatccaacaatgattggtatactcagagttctgcaactctcaccacaatcaattttggaacatttctatcatccctagcaataaatactatatcttttt

SEQ ID NO: 170 - DNA, 3011 bp, Homo sapiens
gcagcagctgcggcggcggcggcgtttgagtggaggaagatggcggctccgggcggctcggggtcccgccagctgtgaggagccccgagcacggctgtcgcggcctgaggcagagcgcctctgctctggccctgtccctggctccctcattaccgtcgccagcggagcgaacccgagagcgtggagcgggctgggccagctgttgagtggaatgtcatggccagctcctcagacagtgaagatgacagtttcatggctgtggaccaggaagaaactgtgctggaagggacaatggatcaagatgaggagccccacccagtattggaggctgaggagactagacataataggtccatgtcggagctgccagaagaggttttggagtatatcctgtcctttctctcaccgtatcaggaacacaaaactgcggcccttgtctgcaaacagtggtatcgacttatcaaaggtgtagcccatcagtgttatcatggtttcatgaaggctgtccaggaaggaaacattcagtgggagagccgtacctatccttatcctggaaccccaatcactcagcgcttctcgcacagtgcatgctattatgatgctaatcagtctatgtatgtgtttggaggctgtacccagagcagctgcaatgctgctttcaatgacctctggagacttgacctaaacagcaaagagtggatccgacctttggcttcagggtcctatccttcccccaaagctggagcaactctggtcgtgtacaaggacttgctagtgctgtttggtggctggacgcggccaagcccttatcccctacaccagccagagagattctttgatgaaatacacacttactcaccctctaaaaattggtggaactgcattgtgacaacccatgggccacctcccatggctggccactcctcctgtgtgatagatgataaaatgattgtctttggtggctctttaggatcccggcaaatgagcaatgatgtctgggtccttgaccttgagcagtgggcgtggtccaagccgaacatctctggccccagtcctcatcctcgaggtggccaatctcagattgtcatagatgatgcaactatcttaatcctcggagggtgtggcggtcccaatgctctattcaaggatgcttggttgttgcacatgcattctggtccttgggcctggcagccactcaaggtagaaaatgaagagcatggggccccagaactgtggtgccatccagcttgccgggtgggacagtgtgtggtggtcttcagccaggctcctagtgggagagccccactcagccccagtttgaactctcgcccatcacctatcagtgccactcctccagctctcgttcctgaaacccgagagtaccgctctcagtctccagtaagaagcatggatgaagctccttgtgttaacggccgctggggaacactgagacccagggctcaaaggcagactccttcaggttcccgggaagggagcctttccccagccagaggagacggctctcctatcctcaatggtgggagtttgtctccaggaacggcagctgtgggtggctcttctttggacagtcctgtacaggccatatctccaagtactccatctgctcctgaaggatacgacctgaaaataggactttctttggccccccgacgaggatcactaccagatcagaaagatctgagattaggatccatagatctgaattgggatctgaaacccgcttccagtagtaatcccatggatggcatggacaataggacagttgggggaagtatgagacaccctcctgaacagacaaatggtgtgcataccccacctcacgtggccagtgcccttgcaggggccgtctccccaggtgccctgcgtcggagtctggaagccatcaaagcgatgtcctccaaaggcccctcggcctctgcagcactaagtcctcctcttgggtcttctccaggctctcctgggagccagagtttgagcagtggagaaacagtgcccatccctcgcccagggcctgcccaaggagatggacattccttacctcccattgctcgccgcctgggccaccaccctccacagtccctaaatgttggcaaacccctataccagagtatgaactgcaagcccatgcagatgtacgtgctggacattaaagacaccaaggagaaggggcgggtcaaatggaaagtatttaatagcagttctgtggttggacctcctgaaaccagcctgcataccgtggtacaaggcaggggtgaactcatcatatttggaggactcatggacaagaaacagaatgtgaagtactatccaaaaacaaacgccttgtactttgtacgagcaaagagataatgtgttctaaacccctttccttttctgtggcttttaatttggaattttccagtgtgtaagcatttggactgagaattgggaaaacaaaattactcccagaagccaaaactctttaattcccaaccgaagtcactccaggctgggatcaaatctccattaagaaaaaaaattatatataaatatatatatatatattatatagccaactctgttgacaaaaaaagggagagatttccatcctggttcagataaagttgttgctgtgttttaacaggggctgggctgcctttttctaccttgctggtaactagaccaagaagttagagaatagactaacatcagtaacttcccaaaagaaactgaagagccccctgtaaatctttatgtggccttcttggagttaaaaaatgaaagggcatatgtaagttgcaaaggtggagggttttagactctcatgcttcaggtgctgtcggggtaaaagtaactgtttttccccttctcttaaaaccacagaggacctgtgacagctctgcagaaatgccagtgcctggccccctcttgccttttatggctgaggaaagttacccaacaaaggattttattccaaaaaaaaaaaaaaaaaaaaaaaaaaaaaaaaaaaa

SEQ ID NO: 171 - DNA, 2778 bp, Homo sapiens
gatcttacggtgcgacagtcctcttctcaggccctctggcccgagagcctgttgactctgtgacacactctgaggagctggttgtggtgttttccagcgagggaagaaaagagtaattttttcaaagcatttatagaaacgcagcaaagggaaggtgtgaggttgccgccatgcctggcagagacggagggaggcagttggctccggaatgcggccgccgcagatgttctccgcaaccttccggaagtggaatggcgggagcctcagcattgctgcccaccgaccccccggaagcggaaacagaatccccgcgtgccccttcctcactaccctccaaatcccgctgcagccattgccgcagacacgatgccgaaacgaaagaagcagaatcatcaccagccaccgacacagcagcagcccccgctgcccgagcgggaagagactggagatgaggaggatgggagtcccatcgctcttcacagaggtcctccaggatcaaggggaccactgattccaccactgctgagtctcccacctcctccttggggtagaggcccaattcggagagggcttggccccaggtctagcccatatggtcgtggttggtggggagtcaatgcagaacctccttttccggggccaggccatgggggtcccaccaggggaagctttcacaaggaacagagaaaccctcgaaggctcaaaagctggtctcttatcaagaatacctgcccgcccaaggatgacccccaggttatggaagacaaatccgaccgccctgtctgccgacattttgccaaaaagggccactgtcgatatgaggacctctgtgccttctaccatccaggcgtcaatggacctcctctgtgagactgtgccttcccatccaggctggaaggagctctctgtgacctagcggccatttatttctctgtagccctatgatggctactgtgaggctcttctaacaccctcagtcagtgacacacccatcccatccaccacttcccccgtgtggggtccagagtggtgttgcatcactggtgcgcggcatacgcgctttcttctgatccagcctgtagagactcgcctttgggacccatctttgcttcctttcagttgcctcctggatcttctttcccgtcatcaaatgactgctgaacaggaaacctctttggtgctgtttcttgtgcatctgtccacctgttccccagtattgccctcaattcctgagagccctggagcggtttcctaccattcccttcttttagctgcttgttttaagtcctttttatgtgacattccctacccccaatgttgtcagctgcttgtgaaactcagccaggttgtctaacctggggtcaagtttgggtgactggtgcagagttacttcctaaaaggccactctccctgcctttggatttcatagtttctctgtcagtagcatgatccccaccgctatggtctatctatgatcaccgtgctttgtgaaactgtgcatccccttgtagcctttctcagtgtccgtggcatttttgtgacttcccagcactagaataagttttcctgccaaaatgagtgaggcgcttggtgccctctggactttcccacttcccaacatgggagaattgtgaactttccatcagactgcctccctggccctccccattcttctcctgttggttattctgagtctgacacagacccatgacatgtcttataaagcctccaatggctttatcctacctagatcccttccagcccattttaattagactatgtcattgtgaggccaccagtccattcatttgaattctgtgaatctccaccttgcctatctttgggtagaagctggacagtactgttgccctcttccaatcctcttcccctacatccctggcactggttgttttctgtgaaaacagcagtgaacaggttcagttttgaactggccctgaggaaatgggtcaggagttgtattggcaagagggaggggtgagagctgttggagaactgagaatgaggttttttttttttttttctttttaactttttttatattagtaataaatgcagtggaaaccagcattttatttaatccctgtgttctagtcatctctggagttgcagatgaagctgttctcacctggtggagtcagcttattctttagttcatacacactagtgatggggaatgacaaagcttaaggttcttccaggctgaaaaaaaccaatggaggttccattagcctgtaggcatcaaccagaacaagctgccttatgttcaagggcaaagttttgtaagaaaaaggaaaggccaggtgtccgtggagttatttttaaatattttactttgcagagtttgtgtttatggagtggtaatgatgaaggagtctttcagcagcaatttgcagaatgcctgtgggccaggcaatataccaagcactagagataactgacagccaaagccaatggatttaaaatgtacagggaagacaggtttctcataatcacaaatagcatgtaaagttaaacctgtcaaaagtgctgggaagaagacagggaagaaaagagggtgaaagagagttgtgtaataaagggagtcagggtaggagatgcaactgagacaagctccaaaggataaacaggaggtggggtgggagagggaagtcaaggcaaaggtcttcgctaaaagacctaggggaagaggagctaagaaacctagggacagtgggagatgatgcagaagaaagaggagttagaccactcagggccttg

SEQ ID NO: 172 - DNA, 4246 bp, Homo sapiens
ggttccctccggatagccggagacttgggccggccggacgccccttctggcacactccctggggcaggcgctcacgcacgctacaaacacacactcctctttcctccctcgcgcgccctctctcatccttcttcacgaagcgctcactcgcaccctttctctctctctctctctctctaacacgcacgcacactcccagttgttcacactcgggtcctctccagcccgacgttctcctggcacccacctgctccgcggcgccctgcgcgcccccctcggtcgcgccccttgcgctctcggcccagaccgtcgcagctacagggggcctcgagccccggggtgagcgtccccgtcccgctcctgctccttcccatagggacgcgcctgatgcctgggaccggccgctgagcccaaggggaccgaggaggccatggtaggagcgctcgcctgctgcggtgcccgctgaggccatgccggggccccggcgccccgctggctcccgcctgcgcctgctcctgctcctgctgctgccgccgctgctgctgctgctccggggcagccacgcgggcaacctgacggtagccgtggtactgccgctggccaatacctcgtacccctggtcgtgggcgcgcgtgggacccgccgtggagctggccctggcccaggtgaaggcgcgccccgacttgctgccgggctggacggtccgcacggtgctgggcagcagcgaaaacgcgctgggcgtctgctccgacaccgcagcgcccctggccgcggtggacctcaagtgggagcacaaccccgctgtgttcctgggccccggctgcgtgtacgccgccgccccagtggggcgcttcaccgcgcactggcgggtcccgctgctgaccgccggcgccccggcgctgggcttcggtgtcaaggacgagtatgcgctgaccacccgcgcggggcccagctacgccaagctgggggacttcgtggcggcgctgcaccgacggctgggctgggagcgccaagcgctcatgctctacgcctaccggccgggtgacgaagagcactgcttcttcctcgtggaggggctgttcatgcgggtccgcgaccgcctcaatattacggtggaccacctggagttcgccgaggacgacctcagccactacaccaggctgctgcggaccatgccgcgcaaaggccgagttatctacatctgcagctcccctgatgccttcagaaccctcatgctcctggccctggaagctggcttgtgtggggaggactacgttttcttccacctggatatctttgggcaaagcctgcaaggtggacagggccctgctccccgcaggccctgggagagaggggatgggcaggatgtcagtgcccgccaggcctttcaggctgccaaaatcattacatataaagacccagataatcccgagtacttggaattcctgaagcagttaaaacacctggcctatgagcagttcaacttcaccatggaggatgtcctggtgaacaccatcccagcatccttccacgacgggctcctgctctatatccaggcagtgacggagactctggcacatgggggaactgttactgatggggagaacatcactcagcggatgtggaaccgaagctttcaaggtgtgacaggatacctgaaaattgatagcagtggcgatcgggaaacagacttctccctctgggatatggatcccgagaatggtgccttcagggttgtactgaactacaatgggacttcccaagagctggtggctgtgtcggggcgcaaactgaactggcccctggggtaccctcctcctgacatccccaaatgtggctttgacaacgaagacccagcatgcaaccaagatcacctttccaccctggaggtgctggctttggtgggcagcctctccttgctcggcattctgattgtctccttcttcatatacaggaagatgcagctggagaaggaactggcctcggagctgtggcgggtgcgctgggaggacgttgagcccagtagccttgagaggcacctgcggagtgcaggcagccggctgaccctgagcgggagaggctccaattacggctccctgctaaccacagagggccagttccaagtctttgccaagacagcatattataagggcaacctcgtggctgtgaaacgtgtgaaccgtaaacgcattgagctgacacgaaaagtcctgtttgaactgaagcatatgcgggatgtgcagaatgaacacctgaccaggtttgtgggagcctgcaccgacccccccaatatctgcatcctcacagagtactgtccccgtgggagcctgcaggacattctggagaatgagagcatcaccctggactggatgttccggtactcactcaccaatgacatcgtcaagggcatgctgtttctacacaatggggctatctgttcccatgggaacctcaagtcatccaactgcgtggtagatgggcgctttgtgctcaagatcaccgactatgggctggagagcttcagggacctggacccagagcaaggacacaccgtttatgccaaaaagctgtggacggcccctgagctcctgcgaatggcttcaccccctgtgcggggctcccaggctggtgacgtatacagctttgggatcatccttcaggagattgccctgaggagtggggtcttccacgtggaaggtttggacctgagccccaaagagatcatcgagcgggtgactcggggtgagcagccccccttccggccctccctggccctgcagagtcacctggaggagttggggctgctcatgcagcggtgctgggctgaggacccacaggagaggccaccattccagcagatccgcctgacgttgcgcaaatttaacagggagaacagcagcaacatcctggacaacctgctgtcccgcatggagcagtacgcgaacaatctggaggaactggtggaggagcggacccaggcatacctggaggagaagcgcaaggctgaggccctgctctaccagatcctgcctcactcagtggctgagcagctgaagcgtggggagacggtgcaggccgaagcctttgacagtgttaccatctacttcagtgacattgtgggtttcacagcgctgtcggcggagagcacgcccatgcaggtggtgaccctgctcaatgacctgtacacttgctttgatgctgtcatagacaactttgatgtgtacaaggtggagacaattggcgatgcctacatggtggtgtcagggctccctgtgcggaacgggcggctacacgcctgcgaggtagcccgcatggccctggcactgctggatgctgtgcgctccttccgaatccgccaccggccccaggagcagctgcgcttgcgcattggcatccacacaggacctgtgtgtgctggagtggtgggactgaagatgccccgttactgtctctttggggatacagtcaacacagcctcaagaatggagtctaatggggaagccctgaagatccacttgtcttctgagaccaaggctgtcctggaggagtttggtggtttcgagctggagcttcgaggggatgtagaaatgaagggcaaaggcaaggttcggacctactggctccttggggagagggggagtagcacccgaggctgacctgcctcctctcctatccctccacacctcccctaccctgtgccagaagcaacagaggtgccaggcctcagcctcacccacagcagccccatcgccaaaggatggaagtaatttgaatagctcaggtgtgcttaccccagtgaagacaccagataggacctctgagaggggactggcatggggggatctcagagcttacaggctgagccaagcccacggccatgcacagggacactcacacaggcacacgcacctgctctccacctggactcaggccgggctgggctgtggattcctgatcccctcccctccccatgctctcctccctcagccttgctaccctgtgacttactgggaggagaaagagtcacctgaaggggaacatgaaaagagactaggtgaagagagggcaggggagcccacatctggggctggcccacaatacctgctcccccgaccccctccacccagcagtagacacagtgcacaggggagaagaggggtggcgcagaagggttgggggcctgtatgccttgcttctaccatgagcagagacaattaaaatctttattccaaaaaaaaaaaaaaaa

SEQ ID NO: 173 - DNA, 2303 bp, Homo sapiens
gtttgcgtgcatgcatgtgtgtgcgtgcgcgtgtttgtgtgtgcatgtgtgtgcgtgtctacgtgtgtgtgcacgcatgtgtgtgcgtgtatgtgtgcgtgtgtgcatgtttgtgagtgcatgtttgtgcgtgtgtgcgtatttgtgtgcgtgtgtgtgcgtgtgtgtatgtgcgtgtatgcatgtgcatgtttgtgtgtgcgtgcatatgtgtatgtgtgtgcgcgtgcgtgtgcgtgcatgtgtgcgcatgcgtgtgtacctacccacacctagggggatgcatggctctgtgccttggagagggaaacaggaaatacgttgctccacagtcctgtcatcctggtcaggactactcgcgtggtttgcggacagagtgcaaaatgaaaatgcgaggccccttgttcaggtgatgaagcatttctagacagtgagaggagagcattaagccaagctcaggtcccttctgagtgcatagcctcttgtggctgccaggcagcacacccaggaggccggccctgaccacactgttctctgctggttcccgaagccgatgggctctgtcttaggtcttcttactttgaaaggtctcccggcaggctgtggcaagctgcgcggatacacttttctaaacgtctgcatttatttcctaaaagcacaaatggcctggactagctagtgggtgtggaaccgagcccctagttcacagctgtaccccaaggctggagagggggttgccggtggtggcaggagctctgggctcccagttcaggatgggccacagggcgtcaagcagctgtgagcctttaccattgagctcactgcttggaaataaaacccttcctctgggccttgggcatccaccgggagcttttctcccctttcctgggaggacagcaagccttttccaaccttctgccttcaaagagaagcagggtcatagaagtgctcagtgtcccttccccagtggctggacactcgctcctccagccttcaccccctggagagaaggggagtctgcggagccagtgcctccctgcccagctgggccacacgatctggtctgcgggtgtctgggaggaacctgcttcggagaggctgcgacctcccagctagactctccccttaggatcccatgtatggggatggtaggagagaaaagatccctctgtgtaagtagcctcaagttctagaagaccatggccccgggaggcagctgaccatgaagctgggcttcctgttgttgctttcttccacgagcttttacttttcctgggctggacgctccaaaatgtttgcagttccatttgctttttgcaagtaggtccccatctccatatacattgagcaataatcctcactatgtttcctgattctgtctgggattatatttgctaagtaaaaatgttgacagaaattgcaaactcatctcacctggatttgattgagtcaccttgaatgacataacaaattatggctttgttttcatgcgtcatgcaatcttccggactacgggaagttctgcaagtgttctccaggggcatttcattaatagcgtgtcagcattagttttaatgaatgaacatttgaggtacattctataaatcaatatccttaaaatgtcatctgctaaacattcactgtgacagaaagtagatattttagcaagatctatgttaatgctacttaattttagacatgcatttaaagcctacatggccaatagcccaagtatctttgaactgtgaaatcaacctcagatctcatctgctgtagccccgcaagccggagtctgtgccctccatgacccttcttatcccttggtggccctgcatagataggggagttggcccctgcccaccccgtgttgtattgccttagctccatcagctttgtaccctcacacgtataggtggtgaacttatgtgtaaatacatgtgtacagatgagaaactgcaacaaaaatgtcctgtggatgataaccagctcagtttccggttttctacattctgtgctgtttccagctaagaaaaaggcgaactcccactatataaagggaaaaggttgtattcatttcatgttcctcatgaaatctctgctgtatgtttatggaatggccatgactaaatgtatatatggtatgtaagaggccatgctgttaaatgttgcataaactaacacagattctgtagtcaaaaatatttaacttgttattgtaaaatgtgatttgtcattgagagattatttttctgtatgtatatgagagtattttaggaatctaatttaagtgcataaaactatag

SEQ ID NO: 174 - DNA, 504 bp, Homo sapiens
aaccgaaaagtctctttattgattggtaccatacatgactcaaatggcccaaaaaaaaaggcattacagttgggatgggatgtccaccttcctcaccccttccctcagctcctgactcaatacccttccaaaagtggcagctggagtggaggaaatacggtgtgggattacatatgcagttggaggggctgagggaagattctggaggaaagtggctgagcccctctcccatcccatgcctgcccaactgaaacaaaaccaaaaatacagcaacaaggctgctcccttctctccacgctccctaagggaaggagcctcccctccccgcatcctagacagctgccccttgtggaggacttgtaaggaatatacataccatgggggtggggctggaagagagggagtcacaagcactaggagggcagaactgggatgtcatctgtggctccttcccctctatgaaggacagagtaggattacatatgcagttggacttttaatagg

SEQ ID NO: 175 - DNA, 4482 bp, Homo sapiens
tgaggagccgcccggtcgcctgcgcgctccctccggcggcgtccccagcccgcggcccctctgctgccggcccccggctcgccggctgcgggagtggcctcaagatggatgaagacggcggcggcgagggtggtggcgtgcctgaagacctctcattagaagagagagaagaacttctagacattcgtcgaagaaaaaaggaacttattgatgacattgagaggctgaaatatgaaattgcagaggtgatgacagagatcgacaatctaacttccgtagaggagagcaaaacgactcagaggaacaaacagatagccatgggaagaaagaaattcaacatggatcccaaaaagggaattcagtttctaatagaaaatgacctgctacagagttccccagaagacgtcgcccagttcctttataaaggagaaggcctaaataagaccgtcattggggactacctgggtgaaagggatgaatttaatattaaagttcttcaagcctttgttgaactccatgagtttgctgatctcaaccttgtacaagccttaaggcagttcttatggagcttcaggctgcccggggaggcgcagaagattgatcgcatgatggaggctttcgcttctcgctactgcctgtgcaaccccggggtcttccagtccacagacacgtgctacgtgctgtcattcgccatcatcatgctcaacaccagcctccacaaccacaacgtgcgtgacaagcccacggcagaacggttcatcgccatgaaccgcggcatcaacgagggcggggacctccctgaggagctgctgaggaatttgtatgagagcattaagaacgagccatttaagatcccggaggacgacgggaacgacctgacccacaccttcttcaaccccgaccgcgagggctggctcctgaagctgggagggcgtgtgaagacctggaagcgccggtggttcatcctgaccgataactgcctctattactttgaatacacaacagataaggagcccaggggaatcatcccgttggaaaacctcagcatcagggaggtggaggacccccggaaacccaactgttttgagctctacaatcccagccacaaagggcaggtcatcaaggcctgtaagactgaggccgacggccgcgtggtagaggggaaccatgtggtgtaccggatctcagccccgagcccggaggagaaggaggagtggatgaaatccatcaaagccagtatcagcagagatcccttctatgacatgttggcaacgaggaaacgaaggattgccaataaaaaatagctttcctggctaaaagacccaggtaaaagacccaaccccagcagaaagacaccgcgggcggcccctccgcggaaggcgtggcagggaggcagtcgccctgcggtgcaagctgctgctccagagcataccgtggcccaggtggtatccccaaggcctcgtgccgtggctggggtcctgggaggtggtcgccctgcagtgcaagctgctgctccagagcgtaccgtggcccagactgatcctcgaggcctcctgccgtggctggggtcatggtcggctgcgcatgtccagaagcatttccttcctgcgaccatcccggcgcccctagggggagaagccaggacagcagcttccgctgtctccacagcagacacgggacggattccacagacgggagcctcattcgtaccatgccaaacgcattcactcggggcagtattaaccgttctagaaagccactgttttatagcaaaacaggaaaggaaaagctaccagttttttattcagaatttttctcagatatataggattatagcttttatatgcctttttatattctgaaattataacaaaagatactttctaacagtagtatttttagaatggcagctataaagttaactcctggacacaagtatatactgtgcactgaaaaaatatccatctacacagcacccaaggggagggctgggggcaccggcacgggggcagcgtgcagccctgccctgtcaggctgtcagacaagccccggggggcagcaggtgggctcgggacgggctgggggagggacggccatggcacttgggggctccagggtgactcccatgaggcctcccttcaaccaggctttttggccccacaaatactttaagcaaatcattaaaattataacagttaatggtttgggggtgtttaggctgtaactgctaactcctaggaaacagccttttccctggacacagatggtccatacgctgagccacgtgaaactgctgatgttttgtttagatgcacacacatggcagcgtttcatacaggtcagcaggttagaccggcttttgaccatattcatcgctatttaaaacctgtggcaaaatgaacgcttattttacagactttctaatttgaccagatttcttaatgaatagacacagaattaactaaaaacagtctcaccccatgtagtgcgccgtgtcctgagagaggtgccctccctacgaggagggaagaacaggccctggggtgcagaggcccggcacgtagagaacccagatagacgccggtggtggaactggtcaaactccacgcccgcctgggaggttgtcaggttgctgtggatgtaaggataggaggtgcccagtgctccgctcaaggaaggctggatctgggccccacctacagagagggctcagggctggaccgggggcattgtgtgcttgggccgacccgggccggtggcagacgctgttctctgtcgggagatttgcgtccccaggaccctgttacacagtgggctgttgggttggtggctggcttttcctctatggacttcctcttcctgccccacctgcataggcacacacaccttgaatctgcaccctctggagggcatctgtactcctgtgcaaaatgcccagtccagagacaaaacctcagactttgtgcacctaggtttccttctcagcagcggagactgttctttgagttgccttgaagtggaggccgagcggctgcgggcccttcgcctccctgcggctgaccttgatgtagctttaagtcacactagactgcagaggggtccgaggccagaaacccctgtcctgcatcagactttcattcccacgttcttaggctttgttactgatacctcaaatcggaagttttagttctgagaaaggcaagtcagcgttcttgaaatgcctgactggtagatatgcaactctggcctccagtcttccatgaaaataaatgctgcctggacccccacccagaccacacactgacggccggctccggcggtgcccacccctcaggctggcccggcacccaagactggccacagccagctctgtcagcatgttgtgctcggacaagctgtttccttcttctgaccaacccaggtgtgacctggggatgcagagctttctgttttgggtgttgggagaagcagcaggaaggagtcgccagatgatcaagctccccctttgctgtcatctgtgaatgagcttcgccaggtggtgggcacctgggagccatgcagaggctgtggtgctgagttagactccaggtactttgtggtcaaaggaaatcgcctagctccaggctgtgttaggacagtattagcatgaaggctgtgcgaccatcatgcctgctgatccttgaggcaggcctggtccagaaaactctgggtcagtgactgcgcagggccagccgctaccaggacggccctgaaacaggacacatctgttttttgtccctcaccctgggcaggccgcgtcacaatcacagtcctcctcctccccaccctgacgtctgagcgcagggcttgaattgttagtcccaactctggccaaagatacttttttccagagacagaggccaggaggcagtgaggggagccccgcggggaggcggcggcgactgccacagcccttccagcctgtcttgctggccgccctggttcatatttgagtttaattgtactgaccctggacccagataagcagcaactttgtgtctttggggtcacagaacattttggggcagtttaatgtggtaccaaactgaaaataggagctatttatagatggagcagcacttagtgcttcatagaaagcaatgcctatttttaaagttacaaacgcagatatctacatagatatgctttgctgagaagttaggtctgtggtagaccagaaaccacaaattgactttttttcttagaaaatatttctatttgcggtaaatatagtaatatgtaaataatgtacatctgttgatttctggagtgtctgttattcaatgatgtatatactcccacagctcgcatgaaggaacagcctctattgatacttggttgtaaagtgaagtaagattggagggtggatggctgtcagagctcttgcagatactgtgttcactaaataaaaatcacatgtattgttaaaaaaaaaaaaaaaaa

SEQ ID NO: 176 - DNA, 793 bp, Homo sapiens
atgaggataaatgcagcaaaggatcctggattggatcttgaaacagaaaaagaagacattagtggagaatctggtgaaatccaactccttggcctgatagggtcacagggcccaggagtggtcaaggaagcttctgtgaatgtattgaacgtcaagagtgtccagggggatgtgtggtgtttggcccgattcctgtcattgccagtggaaatgccatctctggagtttgccccaggtgtttgtgaagcaggttgggattcggagctgaacgctcctctaaagatatgtgctggcttcttatgtcatggctagacagcccctgctgggcctgtttgctgtccctttctctttgcccctgagttgtgtcaggagatttgaggaacttctgactcatcctagcaagtggctatggcctttttgcaaaaagctgtgtcccaagggaagaggcaaatgtgacccaggtaggtgccagcagtcacatggcttgcagggatgacaagctcaaacaggacttgatggctgggtgtgatggaaaccataacacatgattcttgggagcaggtccgtgctggctggcaggatatttggctctgtttgtgtttgaacagtctgacaacagccataaagcctagcagctgtgaggtatttcaggtaccggaggacttctggacttcggttaaccttggggtcttgggagtagaactttagctttgaataatttaagggcttggcctgtaacctcacgcctgtaaccccagcgctttgggaggccaaggtgggcggatcacttgag

SEQ ID NO: 177 - DNA, 6416 bp, Homo sapiens
gggtatcctggtctccgcgtgtgtgagtaccgcggcgcgaggttagtggtagctgggtgcagacgccgtggcgctggagacccaaacatggcaaacctggaagaaagcttcccccgaggaggtacaagaaagatccacaaaccagagaaagctttccagcagtcagttgaacaagacaacttatttgatatttctactgaagagggatccaccaaaagaaaaaagagccagaaggggccagcaaaaacaaaaaagttgaaaatcgaaaagagagaaagcagcaagtccgcaagagagaagtttgaaatccttagtgttgagtccctgtgtgagggaatgcgtattttgggttgcgtgaaagaggtgaatgaactggaactggtgattagtctccccaatggcctccagggctttgtgcaagtcactgaaatctgtgatgcctacaccaaaaagctgaatgagcaggtgacacaagaacaacctctgaaggacctacttcacttgcctgaacttttctcacctggaatgctggtaagatgtgtggtgagcagtctgggcatcacagacaggggcaagaagagtgtcaagctgtctctgaaccccaaaaatgtcaacagagtgctgagtgctgaggccctgaagcctggcatgctacttacaggtaccgtatccagcctggaagaccatggctacctagtggacattggtgttgatgggaccagagcttttctgccactgctgaaagcccaggagtacatcagacagaagaacaaaggtgctaaactaaaggtgggtcagtacctgaactgcattgttgaaaaggtgaaaggcaacggaggagttgttagtctgtctgttggtcactcagaggtttctacggccattgctactgaacagcagagctggaaccttaataacttgctaccaggactggtggtcaaagctcaggtacagaaggtgactccatttggccttacgctaaacttcctcacattcttcacgggcgtggttgactttatgcacctggatcccaagaaagctggaacatatttctcaaatcaggcagtgagggcctgcatcctttgcgtccatcctcgaaccagagttgtgcacctgagcctgcgccccatcttcctacagcctggacgcccactcacccgactctcttgccagaaccttggagcagtgctggatgatgttcctgtccagggttttttcaaaaaggctggggccacctttaggctgaaggatggggttctggcctatgcccggctcagccatctctctgattctaagaacgtcttcaatcctgaggccttcaagccagggaacactcacaagtgtagaattattgactacagccaaatggatgaactggccttgctctctctacgaacgtctattattgaagctcagtaccttagatatcatgacatcgaacctggggcagtggtaaagggcacagtgctaaccataaagtcatatgggatgctggtgaaggtgggcgagcagatgaggggcctggtacctcccatgcacctggctgacatcctgatgaagaatccggagaagaagtaccacatcggggatgaggtcaagtgccgggttttgctttgtgaccctgaagccaagaagctgatgatgaccctgaaaaaaaccctgattgagtccaaactacctgtcattacctgctatgccgatgccaagcctggtctgcagacacatggcttcatcatcagggtcaaggactatggctgcattgtgaagttctacaacaatgtgcagggactggtgcccaagcatgagctcagtactgagtatatccctgacccggagagagttttttacactggccaggtggtgaaggttgtcgtattgaactgtgagccatccaaagagaggatgctcttatccttcaagctgtcgagtgatccagagccaaagaaagagcctgcaggacacagtcagaagaaaggaaaagccattaacattgggcagttggtagatgtgaaggttttagagaagaccaaagatgggctggaggtggctgtcctgccccacaacatccgtgctttcctccccacatctcatctgtcggaccacgttgccaacggcccattgttacatcattggctccaggcaggtgacatccttcaccgagtcctgtgtctgagccagagcgaggggcgtgttcttctttgcaggaagccagccttggtctccacagtagaaggtggccaggatcccaagaacttctcagaaatccatcctggaatgctgctcattggttttgtgaagagcatcaaggactatggcgtgttcatccagttcccctcaggtcttagcggactggccccaaaagctatcatgagtgacaaatttgtgacctccacaagtgaccactttgttgagggccagacagtagcggcaaaggtgaccaatgtggatgaggagaagcagcggatgctgctgtcactgcggctgtcggactgtggtctgggggacttggctatcaccagcctcctcctcctgaatcagtgcctggaggagctgcagggcgtgcgcagccttatgagcaaccgagactctgtgttgatccagacgctggccgagatgaccccaggaatgttccttgacctagtggtgcaggaggtgttggaagatggctctgtggtattcagtgggggtccagtgcccgacctggtcctgaaagccagcagataccatcgcgcagggcaggaggtggaatctgggcagaaaaagaaggttgttatcttaaatgttgatcttttgaagttggaagtgcacgtttcccttcaccaggacttggtgaatagaaaagctagaaagctgaggaaaggcagcgaacaccaggcgattgtgcagcacttggagaagtcctttgccattgcctccttggtagagacgggccacctggcagctttctccctgacctctcacctcaacgacaccttccgctttgactcagagaaattgcaggtgggacagggtgtctccctaaccctcaagaccacagaaccaggagtgactggccttcttttggctgtggaggggccggctgccaagaggaccatgaggccgacccagaaggactctgagacagttgatgaggatgaagaagtggatccagctctgactgtagggaccataaagaagcacaccctctccatcggggacatggtcacagggactgtcaagtccattaagcctacccatgtggttgtgactctggaagatggcattattggctgtatccatgcctcccacattctagatgatgttccagagggcacctctcctactaccaagctgaaggttgggaagacggtcactgcccgagtgattggcgggcgagacatgaagacattcaagtatctcccaataagtcaccccagattcgttcgaaccatcccggagctgagtgttcggccaagtgagctggaggatggccacactgctcttaacactcactctgttagccccatggagaagattaaacagtaccaggccggccagactgttacttgcttcttaaagaaatacaatgtggtgaagaaatggcttgaggtggagattgccccagacatccgggggagaattcccttattgctcacttctctgagcttcaaggttctgaagcatccagataagaagttccgggttggccaggccctgagggccaccgttgttggcccagattcctccaagaccctcttatgtctgtccctcacaggtcctcacaagcttgaggaaggggaagtggccatgggccgagtggtgaaggtgactcccaacgaggggctgaccgtctccttcccctttgggaagataggaacagtcagtatatttcacatgagtgactcctactccgagacgcccctggaagacttcgtcccccagaaggttgtcagatgttacatcctgtccactgcagacaacgtattgactttgtcgctgcgatcatccagaacaaacccggagacgaaaagcaaagtagaagatccagagattaactccatccaggacattaaggaagggcagcttctgaggggctatgtagggtccatccagccacacggtgtgttctttcgccttggcccctccgttgtgggtttggctcggtactcccatgtctcccagcacagcccgtccaagaaagccctttataacaaacacctccctgaagggaagctgctcacagccagggtcctacgccttaaccaccagaagaacctggtagagctgtctttcctccccggagacactgggaagccagacgtgctttctgcttccttggaagggcaacttacaaagcaagaggagaggaaaacagaggctgaggagagagaccaaaaaggggaaaagaaaaatcagaaaaggaacgagaagaagaaccagaaggggcaggaggaggtggagatgcccagcaaggagaagcaacagccccagaagccacaggcgcagaagcggggcgggcgggagtgccgggagtctgggagtgagcaggaaagagtgagcaagaagccaaagaaagccggcctgtcagaggaggacgacagccttgtggacgtgtactatcgggagggaaaagaggaggcagaagagacgaatgtgctgcccaaggagaagcaaaccaagccagcagaagcgccccggctgcagctgtcttcaggcttcgcttggaatgtgggactagactctctgaccccggccttgccacctctagcagagagctcagacagcgaggaggatgagaagccacaccaagccacgataaagaaaagcaagaaagaaagggagttggagaagcagaaggcagagaaggaactgtcccgcattgaggaggcgctgatggatcctgggcggcagccagagtccgcggatgattttgaccgactggtgctgagctcccccaacagctccattctgtggctgcagtacatggctttccacctgcaggccacggagatcgagaaggcccgtgccgtggctgagagggcccttaagaccatctccttcagagaggagcaggagaagctgaacgtgtgggtggctctgctgaacctggagaacatgtacggctctcaggagtccctgaccaaggtctttgagcgagccgtgcagtacaacgagcctctcaaagtctttctccacctggctgacatctacgccaagtcagagaaattccaggaagctggtgaactctacaaccggatgctgaagcgtttccggcaggagaaagctgtgtggatcaaatacggcgccttccttctgcggaggagccaggctgcagccagtcaccgcgtgctgcagcgagccctggagtgcctgcctagcaaggagcatgtggatgtcattgccaagtttgcccagcttgagtttcagctgggggatgcagagcgggccaaagccatttttgagaacacgctgagcacctacccaaagcgcacagatgtctggtcggtctatatcgacatgaccatcaagcacggcagccagaaggacgtccgggacatctttgagcgggtcattcatctgagcttggcccccaagagaatgaagttcttcttcaagcgctacctggactacgagaagcagcatggcactgagaaggatgtgcaggcagtcaaggccaaggccctggagtatgtggaggccaagagctcagtgctagaggactagtggcaggctggctctgtgggacactgtcaacaatgggccagcccggccccgcctcgagtgcctgggcactcggaaaactgttacctcaggactctatttaaatgctgctttttctgcagcacgcttggggaaatcctgtcaggatgaaaaggaagttgagattttttaaatccctcttcgcttgctttattttcagtaccaacttgttatctttttccttatctgaggctacctggggattgtgggcagcaggcccctggactcccagaaatgctgagggtccctcttccaggggagttccctggggagcaagagtagaggggctattcccgagggtcctgtggtcagggtcctgctttgtccctggcaggctgtcagtccagctggagggggtcagtaggctccagggagtgggccctcccctccgatcttggagtctctgggtgttccttcagcctcagcctcactggtaccttctgccctttaggggaggctatgagtctgggacaggaggacaaattcagagcccagagggggaaatggagaaacctgggctgctgaggaaagccacgggtgttggcgtgaactgatgatgtctcatcccacgcccactatggccacattacctaacctctccatatctgggctattcaaggtcttggaggccagcacagacccagctagttgttgaagccagttcttttttgtcttgg

SEQ ID NO: 178 - DNA, 329 bp, Homo sapiens
  misc_feature (61)..(61): n is a, c, g, or t
  misc_feature (65)..(65): n is a, c, g, or t
  misc_feature (75)..(75): n is a, c, g, or t
tttgtggtgctcctcctcttcccccgtctcttctcggctggcccggtccggaattcctcantatngggacacggnaatagatataacaataagacagaataataataataggaagaacaggaataatataggatatatttgaaataaaatggccaagatgatacttggaaaacacctaaaataattatgagagcaaacaacatgtatttctgggataaacgtgtattacaaagaaaagcaagcacaaaggccctcgagcaggagtaggcctggagagttcaaggggcagaaaggaggctaatgtattaataggaaaaaaaaaaaaaagg

SEQ ID NO: 179 - DNA, 505 bp, Homo sapiens
  misc_feature (477)..(477): n is a, c, g, or t
aacttaaagatgagccaaagggttatttgattgccttttaattctttactctacgttactcaacatttagatgtcagtacacaagttcagccaaatgcttgtgaaatttcttctgaacgcatcccaggagacttgaccctccccgcttcaggatgctgactctgttttgcctgaaaccagacaagctctgcttcagggtctgtgagtggaagggggtgggtgggaacctctcgcaacctctcctgggacagacacaatgggcaatcgtgacctcctggggtagatactgaaactgtgacaagtgataacaaaactggcagaaatcagttggacccaatatggccaactggagtttctgcagaaagagcttgctgatatcacagcctgaatttccacgcatgtttccgtattaactgccccggaatttgatttgcacacagcacccatgaggaagcatgaagagataactgcgcatgnctgaggacttgccagacctcctctttcc

SEQ ID NO: 180 - DNA, 2743 bp, Homo sapiens
ctcactcggattctttgctggcatgccttcagtttcagttgtcatccagagaagtcaaaggaaatgctgcttggggatgagcatgttgatgataattagaagcatgctttccactgaacttcccgacaacatttgttatgcagaatgtctctgagtgagaactcggtttttgcctatgaatcttctgtgcatagcaccaatgttttactcagccttaatgaccagcggaagaaagatgtgctgtgcgatgtcaccatctttgtggagggacagcggttccgcgctcaccggtccgtgctggcggcatgcagcagttacttccactcaagaatcgtaggccaggctgatggagagctgaacattactcttccagaagaggtgacagttaaaggatttgaacctttaattcagtttgcctacactgctaaactgattttaagtaaagagaatgtggatgaagtgtgcaaatgtgtggagtttttaagtgtacataatattgaggaatcctgctttcagtttctgaaatttaagtttttggactccactgcagaccagcaagaatgcccaagaaaaaaatgcttttcatcacactgtcagaaaacagaccttaaactttcacttttggaccagagggatctagaaactgatgaagtggaggaatttctggaaaataaaaatgttcagactcctcagtgtaaactccgcaggtatcaaggaaatgcaaaagcctcacctcctctacaagacagtgccagtcagacatatgagtccatgtgcttagagaaggatgctgctctggccttgccttctttatgccccaaatacagaaaattccaaaaagcatttggaactgacagagtccgtactggggaatctagtgtcaaagacattcatgcttctgttcagccaaatgaaaggtctgaaaatgaatgcctgggaggagtcccggagtgtagagatttgcaggtgatgttaaaatgtgacgaaagtaaattagcaatggaacctgaagaaacgaagaaagatcctgcttctcagtgcccaactgaaaaatcagaagtgactcctttcccccacaattcttccatagaccctcatggactttattctttgtctcttttacacacatatgaccaatatggtgacttgaattttgctggtatgcaaaacacaacagtgttaacagaaaagcctttgtcaggtacagacgtccaagaaaaaacatttggtgaaagtcaggatttacctttgaaatccgacttgggcaccagggaagatagtagtgttgcatctagtgataggagtagtgtggagcgagaagtggcagaacacctagcaaaaggcttctggagtgacatttgcagcacggacactccttgccaaatgcagttatcacctgctgtggccaaagatggctcagaacagatctcacagaaacggtctgagtgtccgtggttaggtatcaggattagtgagagcccagaaccaggtcaaaggactttcacaacattaagttctgtcaactgcccttttataagtactctgagtactgaaggctgttcaagcaatttggaaattggaaacgatgattatgtttcagaaccccagcaagaaccttgcccatatgcttgtgtcattagcttgggagacgactctgagacggacaccgaaggagacagtgaatcctgttcagccagagaacaagaatgtgaggtaaaactgccattcaatgcacaacggataatttcactgtctcgaaatgattttcagtccttgttgaaaatgcacaagcttactccagaacagctggattgtatccatgatattcgaagaagaagtaaaaacagaattgctgcacagcgctgtcgcaagagaaaacttgactgtatacagaatcttgaatcagaaattgagaagctgggttctgtggaaaatctgatgtgccaagaagtgttccataccattctgagaactctggatacctgctcagacagctctgtttcagctaaacagtaacatctgggagggaagcttaatgtggaatcaaggatgaagtttaacacaggaatgagaagtagagcacatagctgctaagataaggctggagtctcagctcattgcaacctttgcctgccaggttcaagtgattctcctgcctcagcttcccaagtaactgggactacagaatgtaatcatcgcaaggccaggagatgcgtttggtctgtgctgcatctcaagcaggacaatggctggaacatagtagggtctccaaaaatgtttgttgaacgttgctgatggcggcatcctggagtaggaaaaagactgaagagtggaaaaagaaatcctgacatgaattctgggcaaaggcaagcagtagctgacttggaaaatgattacactatagatggcagcacaccactacctacgatccgatcaccagcctgggtttgtaagtcagagctgttggtcaggagatggcagctaatgagtaatcagtccaaactgaatggcaaattaatgtcttcattaagtgaacaaaccagcttcctccataaacaaggtcagagtatttataacccagtgtatttcataaaagcaaaaacgcatctccatttacataactttactatggagctcatgatttatctgcacaaagcatatgcaaaatctcacttgtataccgtctttaataaggacccatgccattctgatgtaattattaataaagtcacacttgataacc

SEQ ID NO: 181 - DNA, 783 bp, Homo sapiens
atgacccgccattggccctgggaggtgagcctccggatggaaaatgagcacgtgtgtggaggggccctcattgaccccagctgggtggtgactgcggcccactgcatccaaggcaccaaagagtactcagtggtgcttggcacctccaagctgcagcccatgaacttcagcagggccctctgggtccctgtgagggacatcattatgcaccccaagtactggggccgggccttcatcatgggtgacgttgcccttgtccaccttcaaacacctgtcaccttcagtgagtacgtgcagcccatctgcctcccggagcccaatttcaacctgaaggttgggacgcagtgttgggtgactggctggagccaggttaagcagcgcttttcagccaactccatgctgaccccagagctgcaggaggctgaggtgtttatcatggacaacaagaggtgtgaccggcattacaagaagtccttcttccccccagttgtcccccttgtcctgggggacatgatctgtgccaccaattatggggaaaacttgtgctatggggattctggagggccattggcttgtgaagttgagggcagatggattctggctggggtgttgtcctgggaaaaggcctgcgtgaaggcacagaatccaggtgtgtacacccgcatcaccaaatacaccaaatggatcaagaagcaaatgagcaatggagccttctcaggtccctgtgcctctgcctgcctcctgttcctgtgctggctgctgcagccccagatgggctcctga

SEQ ID NO: 182 - DNA, 459 bp, Homo sapiens
tttttttttttttttttggagagagagagagaatttaattcaatttagcaagtctttctgaaattccagcatgtacatagcacagagacatcctggaggaacctgtagacttccattttcctgtggatacatggcttgctctcaggaaacatagcatgacagaacagcaacgttccctccttcaggtcagggaccttatctcattctcttagtgttcacaaaacatctagttcacttgagcatacatagtaatcacttgataaataagctgccaaaatgagatgtaccgtgagtatgctataggaataggggacagaggtcagtgtggataaaagtggaggaggtgggttttgaatccaggactaaagtgtgagtaggaggagttagaataacgacatagataagtagggaaactgattggtaaaaagcctcaaataacacacagaattaagggtcaat

SEQ ID NO: 183 - DNA, 485 bp, Homo sapiens
tttttttttcttgggtcttttttattggactgggggcttcctaaggcaggccgggcactatttccctctgtatcctcttttgcaccacctaactcaatttctccaagcctgataagcaaagagccttgcatacagcaagggtgcaataaacccagccaagtggacatcccatctccaagggtcaaggccggatggtgtagctctaaggaaggggcagaccaaatgagctttgacatctctgggatttgatgatcccaggattctgaatccaagaatctggggttgaacgggctccttggagcccagtgtgtgagcagagggagaggacaaggaacaaaaccaaagagatccaagttcagtggagtcccaagcctgctgggaacaatgctggagaaggggtgcagggagagaaaggtaggagcccacgtctccctagctgccctctaactgctgcaggataggccgtcacctgcccatcagcagct

SEQ ID NO: 184 - DNA, 6026 bp, Homo sapiens
gagcctcggtgggaagaaggggcttctgggtggggagtgggagagagacttccttggggagaggaattcagctgcacgctggagtcagctggagttgcccaggccctgtgagcaagtggcaggcgtgcccagctgcattggggagagggctgttctcaaggccaaggtcatttttggagggagaactggacgcctgatcaaatctggcccacaatggactcagcagccaaggatgagatgcagccggcgttgtcccctggacctgagtggccagagcaggagcgggcagagcagctggcccggggtgcagcgctcaagtgggcctcaggcatcttctaccggccggagcagctggccaggctaggccagtaccgcagccgcgaggtgcagcgtacctgctccctggaatcgcgcctcaagtcagtgatgcagtcatacctggaaggcgtgcagactggtgtgtggcagctggcccaggccattgaggtggtgcagggaacccgggaggccctgagccaggcccgtgggttgctccagggcatgtcccaggccttacagactctagagcccctacgggagcgggttgcccagcacaagcaactgcaggccctgtctcacctgctgcctcggctgcgggcagtgccggctgcagtgtcccacacacagactctgattgatggccaacagttcttggaggcatatgtgagccttcgggagctggagcagctgcgagaggatacgtgggcacccctggggggcctggagttgccagtcttccaggggctggaccttctgttcgaggcactgggccaggctgtggaagcagctgcaggggccgcagggaagctggcacgggaggacccagccctgttggtggctgctgtgcgtgtggcggaggtggagactggacgaacaacccccctgggccaggtcccccgggactggcgtcagcgctgtctgagggcactacaggagggcctggagcaggcccactttgggtcacctctgctgcctgcaccaggggccctaccagggtggctggaggctctgcgagtggccctgccagtcgagttggccacagctgaggcactagtagcgccttgctgcccgccacagtacaacgtggtccagctatgggcccacacgctgcatagtggtttgcgccgcagcctgcagaacctccttgcagggcctgagctagaagctgcggatgccttcgccttgctgcactgggcactgcatgtgtacctggggcaggaaatgatggggagcctggagttggggcctgaggctgatgtgtcccagctggagccccttctgaccttggagaacattgagcagctggaggcaacatttgtggccaacatccaggcaagtgtgtctcagtggctgcagaatgcactggatggggaggtagctgagtggggccgggagcatgggcccaacacagacccgtctggctcctattactcaccaatgccagccattgtgctgcagatcctggaagagaacattcgtgtggccagcctggtcagtgagtcactgcaacagcgagtgcatggcatggcactgtcagaactgggcacattcttgaggagcttcagtgatgctctgatccgattctcccgagaccacttcagggggaaatcaatggcccctcattacgtgccctacctactggccgccctcaaccacaagtcagcactcggctcctcagtgtctgtcctgcagctggacggggcgccttcaggggccttggctccagtggaagctgcgctggacgagttgcagaggaggatctaccgcttggtgttggaggcgctgcaggcggagctccagcccctgttcgcggatctgccctcgcgccaatggctgtcgagccctgagctcctgcaaagtgtgtgtgaacggacggggcgcttctgccgggacttctggcgcgtgcggaaccccacggttcagctgctgctggctgaggccgagcgtgccgtggtgctccagtacctgagcgcgctgatgcaaggccgcctggtgtgccgcggagccgacgagaggacccaggcggccgagcgcctgcggcacgatgctgcccagcttcagcagcttttcctcagtttgggcctggaggagaacgcgcactgcgcgccggtgctgctcgccctgagggagctgctaaacctccgcgaccccgcgctgctgggcctggaggtggctggcctgcggcaacaatttcccgacgtgagcgaggaccacgtctccgccctcttgggcctgcgcggggacttgtcccgggagcagcacctggccgcgctcagctccctgcaggctgcgctgccgccgtcgccccgcgcgagccgccgcgtcctcttcagcctagtgcccgcgcccgcgctcgcgccggcctcctgcctgccctcggggtcctgcgcccgagccctgctgctcgcagaataaaccacggctgccggacgcctgagtctgttggcctcgggggcgcgccgccgcggagactgacgcgaagccccacgctttcgtaagagcgtgcgcgcgcccgaggacgtacgtcatcggcgacggctcccgccggctgggcgtccggtggccggtgtagcagagcgggagcggcgggcggcgagcagaggagctaacaggtgggggcacggcacgcggacggacccccccaaaggccgggaggaggcgcgcgacgcgacctttcctgatctcccggagaagcctccactccattgtctcctggccccaccctccattgggcacgcccttcaccttatcccccaccacttattggctgcaggtcacgcccctcctctatttctggttccccattggctcttcaccttgtcctctccggggcttctctccgcacaggccacaccctctcatttgtcactagaccccgccttaatagtggggggctcctcccccatccatccttcattcattatgcacccagtgctgggtgcttggtacacgggggtgaatcagaccccattcctgccttcggggagttcaggggattgtgggaggacacggacctagactccaacagtgacagctctgagtaaagaagtcgccgaagcagtgggacactagacgcggggaaggcttcctggaggaagtgaggcctaaactgagccttgaagaatggttaagagtttgctccaggaatatattgcaaaggcattcttggcggaaggacccgagacgtgaaaaaaacaggcgtattctggtaatttcgaggagatggagaagtaacagcatgtgtttatcctgatggaaagagtccagtagagaggaagagattgatgatgtaggagagaggagaaatgctggaaaggtcgacagtgtggggagttggagtgacccggctggatgtgacccccaggacagaatggtgctggactcaggggctcaggcgtatgatcaggcaccccccagcccgcctaccagtcccccatccctgcgccataggctgaagccctcagaccgagatgggccaccactgtacccctggtctcagtccctggccttgcccctggctctggcagtccccccagcgctgcagccccagcctgagcagcagccgttctcacagatgctcctgggccaccgtggccacatgcgtcgcagtgagagcacctactctgtaaatagtactggccggcgggggcgtggcaccctgggacggcctccacctggacggggacggaacccaggtgggggcaccctgcggcctgcagcctccctgcctcacattgctaagactcaaagggatgcaggccatattgccagcaagagcccctgcatgttggtggccctgcggccaaccaacatggaccgtgagcgagacaagttcttccagtcccattacacctacaatccacagtttgagtaccaggagcccatgcccacggctgtgctggaaaagtactgcgaggcctctggacagttcatccatcaggcagttggcatcattgaggctgttctggagaagtttggaacctatgaacactttgaggctgccactggggggcagctgctcaccaagtgccagatatggtcgattgtgcgcaaatacatgcagaaggagggctgcgctggggaggttgtggtgcagctgagtgaggacctgctgtcccaggcagtgatgatggtggagaacagccggcccacattggcgatcaacctgaccggagcccgccagtactggttggagggcatgctgcggcatgagatagaggcacccactacctgcggggcgtgaacaacgcgcgccagccgtggcacaacgcggagggccggctgcggtacgggctgcggccggcgaaccccacggaggagggcctggccagcctgcacagcgtgctgttccgcaagcagccgttcctgtggcgcgctgcactgctctactacaccatccaccgcgccgcgcgcatgtccttccgtcagctcttccaggacctggagcgctacgtgcaggacgccgatgtgcgctgggagtactgcgtgcgcgccaagcgcggccagaccgacacctcgctgccaggttgtttcagcaaggaccaggtgtacctggacggcatcgtgcgcattctgcgacatcgccagaccatcgatttcccgttgctgacctcactgggcaaggtgtcctatgaggatgtggaccacctgcggccccatggggtgctggataatacccgggtgccccacttcatgcaggacttggcacgctaccggcagcagctggagcacatcatggccaccaaccggctggatgaggcggagctgggtcgcctgctacccgactgatgtccgttgagggctgcagtcagaggccctggacagaagctccagataggcccctagaacatgaagcagtttgctctgtgcgtccacggcctaggtgtttcttgggggtgttgggagggcaggagcattccttgaggaggagtggcaacatcaaagtgtttgtgtcccttgccagcctccctggggtctggggacctgcagcagcatgtctggcaaactgagtcgccctcctgcctccagctctctgttgagcagagggaaggcatgggggcaggaagagagctgagcattgatggggatgggggtggtttgggaatagaaacttgttcttgcatgagatggctttggttgtcccagtactccagtctctcccttcccttacctggccccttggtgctccttcagcatttgtgctgtctacctctcactgggtcctggtgggggtcgggctcccttctcctggggtgattgatggcctgagcctggggtcctggtagtagagacccagctggcctggggtctgctttccgacattttgcctctctcactggtcatgtatttattccatatttatatggtctacttcctgtggctgggagcagcagctcctgaaggttccgtgggggtgcggggggttggacaggacactccttcttggaaggcaccaattttcccagccccactcccattacacacacacacacacacacacacacacacacacacacacacacacacacacacacactgattcaggccttgagagtcaagcccaagagctcccttggccctgttccccactccctccactggcctctgctgttcctgtctttgctcacaccctcacagctgctctctggcagaggttggcatagcctaggagcagctgcaattgcacctgagggacaggccctagagtttggtggcccaagtcctgaacccctcttagaccaggtgaggtgcagaggtggttgctgcttccagtttcccttcagacttagctgtgtgaaccccactcctatcctttggccttagttttcccatctgtaaaactcagaaacgcagttggaaagtccttattcatttagtaagcgaatatattataatatgtatagagcgccttttgtgtaagtcactggtcagaatcctcactgagctcccagtccagagagaagccagacaattaaaacagtaatgac

SEQ ID NO: 185 - DNA, 631 bp, Homo sapiens
cgaggccaagaattcggcacgaggaaaaaagtgatgttttagcatggacttggaggaattaaagactcatcaagtggagatctcaggaaacagtgttatcactcagagaaaacacacaggacaatgcaactgacagagcatcctgggtgtttgtggaacaccaagaagcctagtgcggctggaactgaatgtgcatggaagttggagagatagatggaaacaaattgtgtagtcttttatgccagcgtagagaggttgtaatatgttcctgtgtgttcaaaaatgtacctggggttttttgcagtatggtctgataagaaactcggacatgcaaatgattgccaggaaggaagaactttcaactcacggagttttagaaacagtaggcaaaacacatcctgcagggctatgtgagaagcaccagggtggtataagaagcagaagcagaggagaaagcagaggccagatcctttattgttttccacaggaaaagaaaggcagggctgggtaaccagaagaggatttgctggtttgaataaagttggtagactttggggtctaggagctgtccctgtctgcctagtacctggccctggagtcattagagcaaaaaaaaaaaaaaaaaacgatt

SEQ ID NO: 186 - DNA, 1152 bp, Homo sapiens
caaggaaggagtcctgggagcatggctttccctgagccaaagccgcggcctccagagctgccgcagaaacggttgaagacgctggactgcgggcagggggcagtgcgagccgtacgatttaatgtggatggcaattactgcctgacgtgcggcagtgacaagacgctgaagctgtggaacccgcttcgggggacgctgctgcggacgtacagcggccacggctacgaggtgctggatgcggccggctcctttgacaacagtagtctctgctccggcggcggggacaaggcggtggttctgtgggatgtggcatcagggcaggtcgtgcgcaaattccggggccacgcagggaaggtgaacacggtgcagtttaatgaagaggccacagttatcctgtccggctctattgattccagtatccgctgttgggattgccgctcacggaggcctgagccagtgcagacgctggatgaggccagagatggcgtgtccagtgtgaaggtgtcagaccacgagatcctggcaggctccgtggatggccgcgtgagacgctatgacctaaggatggggcagctcttctcagactacgtgggcagccccatcacctgcacctgcttcagccgggatgggcagtgcaccctggtgtccagcctggactccacattgcggctcctggacaaagacacaggggagctgctgggcgagtacaagggccataagaaccaggaatacaagctggactgctgcctgagcgagcgtgacacacatgtggtcagctgttctgaggacgggaaggtgttcttctgggacctggtggagggtgcgctggctctggccctgcctgtgggttccggtgtggtgcagtcgctggcctaccacccaacagagccctgcctgctgaccgccatgggaggcagcgtccagtgctggcgagaggaggcctatgaggcagaggatggagcaggctgaagccaggggacccaccaacaggaccaaggaccgagacacagacatggaaggacttcagataccatcttattctagagacgtagctgaccaaaaagtaggggaggggctgggtctgcaaattaataaatagaagagggggtaagaccttcctgggaccgcaaaaaaaaaaaaaaaaaaaaaaaa

SEQ ID NO: 187 - DNA, 1403 bp, Homo sapiens
gggaagaaaagggaattccaacctgtggaaccttggggggtccccggggtcggcgccttcccattgactgtgggcggtgcaagggacggagcctctggcggctcgtgggggtgttggggtccgcagggggagggaggggagtgtcagagtgtgagcggggtacgggaattccaaatttgagggcctcccggctctggcgccggggagggagagctcaggccgccatgcgggacaggacccacgagctgagacagggggatgacagctcggacgaagaggacaaggagcgggtcgcgctggtggtgcacccgggcacggcacggctggggagcccggacgaggagttcttccacaaggtccggacaattcggcagactattgtcaaactggggaataaagtccaggagttggagaaacagcaggtcaccatcctggccacgccccttcccgaggagagcatgaagcaggagctgcagaacctgcgcgatgagatcaaacagctggggagggagatccgcctgcagctgaaggccatagagccccagaaggaggaagctgatgagaactataactccgtcaacacaagaatgagaaaaacccagcatggggtcctgtcccagcaattcgtggagctcatcaacaagtgcaattcaatgcagtccgaataccgggagaagaacgtggagcggattcggaggcagctgaagatcaccaatgctgggatggtgtctgatgaggagttggagcagatgctggacagtgggcaaagcgaggtgtttgtgtccaatatcctgaaggacacgcaggtgactcgacaggccttaaatgagatctcggcccggcacagtgagatccagcagcttgaacgcagtattcgtgagctgcacgacatattcacttttctggctaccgaagtggagatgcagggggagatgatcaatcggattgagaagaacatcctgagctcagcggactacgtggaacgtgggcaggagcacgtcaagacggccctggagaaccagaagaaggcgaggaagaagaaagtcttgattgccatctgtgtgtccatcaccgtcgtcctcctagcagtcatcattggcgtcacagtggttggataatgtcgcacattgttggcactaggagcaccaggaacccagggcctggccttctctcccagcagcctggggggcagggcagagcctccagtcggaccccttcctcacactggcccctatgcagaagggcagacagttcttctggggttggcagctgctcattcatgatggcctcctccttcaggcctcaatgcctgggggaggcctgcactgtcctgattggccgggacacacggttttgtaaaaaattaaaaaacaaaaaaagagcataaaaaaaaaaaaaaaaaa

SEQ ID NO: 188 - DNA, 535 bp, Homo sapiens
cttcagtttactgtttttaatgtatcatattctagatttcattacacatcaaagatgaataatttctatcatctttcagacatgcccaaaacactcattagcgattttgaacagtattctttcctaaacatcctagttggaatggttgatcctaaaagctaccacgtgtcaggctcacttaagtacagactctggtcaaaacaagctgaagttttaactcttccatcttcaaatactgagcatatttgcttgttttgctctttagcaaaacactgcaaagtcatttgccaggatcccccgcagattggcattcagtgatggagaacagactcctaggtgagatccctggtcacaggatcccgatgactatgactgcaagtctcttatcacatgggacacattatactggacccaggatggggctgaactgggagaggtagctgtggacctgctcctcgctctgccctcaccctaagagctgatggggcatccaccaggaagagcattcctgggcagggagagggccatgagcagc

SEQ ID NO: 189 - DNA, 1454 bp, Homo sapiens
ggtaaggtgtagctgttctgtcccagtccccgtagctctgcaccgagcagaagaggtctagggtcacgcaggggccatggctgaggcacttgggcttggttctggcaggcggagcggacggggctgagagcggggccctacgggcggaagaggagcactggaagaaggaagagacaaatgttggggtctacggattcagttccagtttaatgatgtggccctctaaggagataattttgccttaaacagaaagacttgaccctcttaggtgtcatacctaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaattttaaagtttgactgtataaattatcagtccctcctgaagggatctaatccaggatgttgaatgggattattgccatcttacaccatatttttgtaaaatgtagcttaatcataatctcacactgaagattttgcatcacttttgctattatcattcttttaagaattataagccaaaagaatttacgccttaatgtgtcattatataacattccttaaaagaattgtaaatattggtgtttgtttctgacattttaacttgaaagcgatatgctgcaagataatgtatttaacaatatttggtggcaaatattcaataaatagtttacatctgttaaaaaaaaaaaaaaaaaa

SEQ ID NO: 190 - DNA, 507 bp, Homo sapiens
ctcctttcattttgcctcttggattgtcatgaacttcctgagcaagaaggccatccaccatgcagtgtaatgtcttgctaagagaaattagtattcagtctgctcaggttccagcaaggactttcttcatgaagatcttcaagtggaatcaagcagccttgcccatgaagtcatgcctgtggctccactgagaaattcgattaagtattccaatactgctgtgaaacgaagtgatctgattccggtgagacaatttatcttgcaagatgaagaagttacctcagagaagtcaaataatttacccagagtcacaaaataagcaaatgatggaatattcaaatccaggtcttctgactctacctctatctgccttagaggtttctgaagtattgataagatggaggctggaagagcttgaaacagaccatataaagaggtctgagctggaaaagcaaagaggcccaaggaacagcacagaccctgactggtggggtatctgtgtatttt

SEQ ID NO: 191 - DNA, 653 bp, Homo sapiens
ggcagtaagattggagctaggcatggttaggaaagctgattgcaggaagagagtagggtaagaaatcgactactagatctgctaatggttagctgttcattatttatttagcacttagccctaaataatgcagccatatcttaccctttcgttggcatggaatacagtgtgtgtaatacacacaaggtgcagaggcaattgtggccatacccaaagaaacagcgccagctcttgcaacgctatgttgaaggatgttattatgaaccctatcatagactaggcctatggcaagtcaagttggagtgaatgtgtcccagttgttttcagaaaagagcagactaggtagagagacaaggagaacattgagaatgtgaaagatggtgtttacgtttggtgtttgttatttccagctctaggctggaagtttaattgccattgatccaagactgccaagaaagcctttttggagttaggttggaggagttatttaaatgagtttgcttgaatatctcttaagtaaaacctgtatggtctgttaactcaagatttaaatctgtactttcgagctccatagtcacaattttggaaagattccccactttatctttttcctagaaactctcagcatggacatgatgacagcatgaactgat

SEQ ID NO: 192 - DNA, 522 bp, Homo sapiens
atgaagaaaaccaagagtgatacacagaaagtccaggatactggaaagagaggaaagggcacaggggtctgtgggacgttgatggtttgcggaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaa

SEQ ID NO: 193 - DNA, 711 bp, Homo sapiens
tgccagtcttgtaaatgcagattctgatccagtgggtctgggagctgagactcacttctaacaggatcccaggtgacacaacgctgtggcccgcggaccacatctgtgtagcagggccctgccccctttccatctgccgctgccccaaatggggcacatctgaagtggccaagaatgcaaggtcaaagccaccaggatgggatataggggccttgtcctccccttcccctgtggaattgcttggtgatgtggagggaagctgcagcttcttgtctgcctgcagcggcaaggccgaggctcagcagaggagcggccgcccacagcctggcttcctgcctaccttgaagaccctgtagcaggcagagcaagagctgtagggtgggcatggggtcccagagctgggcgacaaggcaacaggacctggtggggttggtactgggttctgctggctttggagtggctgtggcagccctgggagacatcgggttgggagcaggagagctggggacgggcaggctggatcgcactcaggcgcctcccagtctgaaagcctggcccctcggctcgggtcctccctctagctggtggagtatctgccctccacagagaggaaagacggcaaggagcttggaaagaaaaagaatccttgaaagcaggagagagcgagcctggcccaggaaaggcagctggagtgagaagggacacagctga

SEQ ID NO: 194 - DNA, 432 bp, Homo sapiens
ttttttttttttttttttttttttttgacttcttcctctactctgtttatttgcttataaagtgtagatttagtgagcacaaggtgaatgcgtaattgctccctccacccctccttttcatgcaacgtggggggctcagtgagatgtaatcaaagcctcagaagattgtgactctcccgtcttgcttttttctctttcatctttcccctcctccagcttttccccctttcaatattgaagcaggacgtattgtgactgcatctgaggtcaggtgtggggtggtccatgtggacagtgaggaaggtggtccctgcccgtggtggtccgggtttcctgggagatggccagacgtgggtgctgaggggaagaggccggtgcagtcactggatggtagagagcatgtccattgtgctgagtgggctgggagggatc

SEQ ID NO: 195 - DNA, 6028 bp, Homo sapiens
ggtgtggacgttgtctaaatttcggtagccatggcacaagaatataagaaagcatgggattatggcaaccacagaatctcagtagtacaagttccattcagttttttctgaaagaaagccctctgttaaagtgaagcaaagaaactgttgtggattataacgtttagaagttccaatttttcagtgctttacaaataaagcatcatttaaccttttaaatgaaaaagattaagatctcatgcaactgttgtattttctggaagccattctccaaaagggaagtgcacatttaaaacacagatatgatggtccttgctgcagggatttaagtctacttgcttttacatcatgaccagcttgaaacggtcacagacagaaaggcctcttgccactgacagggcctctgttgttggcacagacggcacccccaaagtccacactgatgatttctacatgcggcgcttccggtcccaaaatggcagcttaggatcatcagttatggctcctgtaggacccccccgaagtgaaggttctcaccatataacctcaacccccggagtcccaaaaatgggggtaagggcaaggattgcagattggcccccaagaaaggaaaacataaaagaatctagccgttcaagccaggaaatagaaacctcaagttgccttgatagcctgtcctccaaaagcagtcctgtgagtcagggaagttctgttagcctcaattccaatgactcagccatgctgaaaagcatacagaacacgctgaaaaacaagacaagaccgtcggagaacatggactccagatttctcatgcctgaagcctaccccagctcccccagaaaagctcttcgcagaatacgccagcgaagcaacagtgatatcaccataagtgaacttgatgtggatagctttgatgaatgtatctcacctacatacaagactggaccatcactgcacagggaatatggtagcacatcttcaattgataaacagggaacatctggagaaagcttttttgatttgttaaagggctacaaagatgacaaatctgatcgaggtccaactccaaccaagctcagtgactttctcattactggtggtggcaagggttctggtttctctttggatgtaatagacgggcctatctcacagagagagaacctcaggctttttaaggaaagggaaaaaccactcaagcgacgttcaaaatctgaaactggagactcctctatttttcgtaaattgcgcaatgccaaaggtgaagaacttgggaagtcatcagatcttgaagataaccgatcagaagactctgtcaggccctggacatgtccaaagtgctttgcccactatgatgtccagagtatattatttgatttgaatgaggcaattatgaacaggcacaatgttattaagaggagaaacaccaccactggagcttccgcagctgccgtggcatccttggtctctggacctctgtctcattcagccagttttagctccccaatgggcagcacagaggacctgaattccaaaggaagcctcagcatggaccagggagatgataaaagcaatgagcttgtaatgagctgtccatattttcggaatgagataggtggagaaggggagaggaaaatcagcctttcaaaatcaaattctggctcctttagtggatgtgaaagtgcctcctttgagtctacccttagttcccattgcacaaatgcaggagtggcagtacttgaagtgcccaaggagaacttggtgttgcacctagatagagtgaaaagatacatcgtggaacacgtagatctgggtgcatactattatagaaaatttttctaccagaaggaacactggaactattttggggctgatgagaatcttggtccagtggctgtgagcattcgaagggaaaaaccagatgaaatgaaagaaaatggatctccgtacaactaccgaataatttttagaactagtgagctcatgacactgagaggttcggtcctggaggacgccattccgtcgacagccaagcactcgacagccagaggcctgcctctcaaagaagtgctggagcacgtggttcctgagctcaatgtccagtgcctgcggttggccttcaacacacccaaggtcacagagcagctcatgaaactggatgaacaagggctgaactaccagcagaaagtaggcatcatgtactgcaaagctggacagagcactgaagaagagatgtacaacaatgagtcagctggcccagcctttgaagaattccttcaactattgggagagcgagttcggctcaaaggatttgagaagtatcgagcacagcttgataccaaaactgactccactggaacccattctctgtacacaacatacaaagattatgaaattatgttccatgtttctaccatgctgccatacacacccaacaacaaacaacagctcctgaggaagcggcacattggaaatgatatcgtaacaattgttttccaagagcctggagcacagccattcagcccaaaaaacatccgatcccacttccagcacgttttcgtcatcgtcagggtgcacaatccgtgctctgacagtgtctgttatagtgtggctgttaccaggtccagagatgtgccttcctttgggcctcccattcctaaaggggtcactttccctaagtcaaatgtgttcagggacttccttttggcgaaagtgattaatgcagaaaatgctgctcataaatcggagaagtttcgggccatggcaactcggacccgccaggaatacctgaaagatctggcagaaaagaatgtcaccaacacccctatcgacccttctggcaagtttccgttcatctctctggcttccaagaagaaggaaaagtctaagccatatccaggagccgagctcagcagcatgggggccattgtatgggcagtccgggctgaagactacaacaaggccatggaactagactgccttttagggatctccaatgagttcattgtgctcattgaacaggaaacaaagagcgtggtcttcaattgttcctgtagagatgtgatagggtggacttcaactgacaccagcctcaaaatcttctatgaacgaggagaatgtgtttcagtgggtagttttattaacattgaggagatcaaagagattgtcaaaaggttgcagtttgtttcaaaaggctgtgaatcggtggagatgactctgcgaagaaatgggctaggacagcttggcttccatgtcaactatgagggcattgtggcggatgtggagccctacggttatgcctggcaggcagggctgaggcagggcagtcgcctggtggagatctgcaaggtggcggtagccactctgagccatgagcagatgatcgacctcctgagaacatctgtcacggtgaaggttgtcatcattcccccgcatgatgactgcaccccgcggaggagttgctctgaaacctaccgcatgccagtgatggagtacaaaatgaatgaaggtgtttcatacgaattcaagtttcccttccgaaataataacaagtggcagaggaacgccagcaaggggcctcattcacctcaagtcccgtcccaggtgcagagtcccatgacctcgcggctgaatgctggaaaaggagatgggaagatgcctcctccagaaagagccgccaacatccctcgaagcatctccagtgacgggcgcccactagagaggcggctgtctcctggttcggacatctatgtgacggtctcatccatggctttagcaagatcccagtgtcggaactctcctagcaacttgtcttcatccagtgatactggttctgtggggggcacttacaggcagaagtccatgcccgaagggtttggagtgagccgtagatccccagcctccattgacaggcagaacacccagtcagatattggtggcagcggaaaatccacgcctagctggcaaagaagtgaggatagcattgctgaccagatggcttacagttatagaggacctcaggatttcaattcttttgtcctcgagcagcatgaatatacagagccaacatgccatctcccagcagtatcaaaggtactgccagctttccgagagagccccagtgggagattaatgcggcaggatccagtggttcatttgtctccaaacaaacaagggcattctgatagccactactcgagccactccagtagcaatactctctccagcaatgcgtcaagtgcccatagtgatgagaagtggtacgatggggaccgcacagaatccgaactcaacagctataactatctgcaaggcacctctgctgacagtggcattgacaccacctcttatggccccagccacggcagcacagcctcgctgggggctgccacatcgtcacctcgctcagggccaggcaaggagaaagtggcacccctatggcacagctccagtgaagtaatctccatggcagatcggactttggagacagagagccacggcctggaccggaaaacagagtcttccctgagcttagacatacacagcaagagccaagccggctcgacccctctgacaagggagaacagcaccttcagtataaacgatgctgcttcccacacaagtaccatgagctcccgacactctgccagcccagtggttttcaccagtgcccggagttcacctaaagaagagcttcatccagctgccccctcacagctcgcaccatccttctcctcctcttcctcctcctcctctggtcctaggagtttttaccctcgccagggcgctactagcaagtacctgattggatggaaaaaacccgaaggaaccataaactccgtgggatttatggacacgagaaagcgtcatcagagcgatggcaatgaaatagcccacaccaggctgcgtgcctcaaccagagacctccgggcatctcctaagccaacctccaagtccaccattgaagaagatctaaagaaactaattgatcttgaaagcccaactcctgaatcacagaagagttttaagttccacgcactctcctctcctcagtctcctttccccagcacccccacctcacggcgggccttgcacagaacactgtcggacgagagcatttacaatagccagagggagcactttttcacctccagggcgtcacttctggaccaagccctgcccaacgacgtcctcttcagtagcacgtacccttctctccccaagtcgctcccgttgaggaggccttcttacaccttaggaatgaaatcgctgcatggagagttctcagcctcggacagctccctcactgacatccaggagacccgcaggcagcctatgcccgaccctggcctgatgcccctgcctgacactgctgcagacttggattggtccaacctggtagatgctgccaaagcctatgaggtccagagagcctcattttttgctgctagtgatgaaaaccatcgccccttgagtgctgcatccaacagtgatcagctggaggaccaggctctggcccagatgaagccttacagcagcagtaaagactcctctcccactctggcttctaaagtggaccagctggaaggtatgctgaagatgcttcgggaagatttgaagaaggaaaaagaagacaaagctcaccttcaggcggaggtgcagcacctgcgagaggacaacctgaggctacaggaggagtcccagaacgcctcggacaagctgaagaagttcacagaatgggtcttcaacaccatagacatgagctagggaaggctgaggaggacaggagaagggcccagacactccctccagtgagtgtcctgcagcccttattccctccatagaaagcatcctcagagcaccttccctggcttcctactctgccccctttcggggagtgcacaacacaatagttgcagatcaacaatcatcacctgccttttgtagaaaagaaaaacaaaaaaagtaaataaaaattttaaacagtaaaataaaagtttaactgctaaaaaaaaaaaaaaaaaaaaaaaaa

SEQ ID NO: 196 - DNA, 2136 bp, Homo sapiens
ggcttagccattatgtgttagaacctatagatgcagagaatagtttggcatgccctttctgcaagggtttgtcacattttatagggtatacatctgaagttattcatttattttactttttggtaatttttaaaattatttttcaataaacccttttggtcgcaattactctctccccaaaagcaccttttaaggaaaaatggattactggatttgtcaagaaagttgatattgaacgtgtaacctgtcaatatttaccattcacataaaagtcagaacagtatcactgaccagatttctaaaagaaagaaatctattgaagaaggcttcacaatttttaaaattttaaacatttcaaagatgagcatgtaagaaacacaatgcagcatttttgcatattgttttcaaagaatgacttttcatttaggtgagacaagtaactctcaagataatttcattctttctggagttcaggttttctcgcacacatgtaaaaatgtaggtatagcttttaatatcttggctcagttagcaaaagagctttacaaacagttaagtgatcctgccaattttatatcacagccatctcatcagatacttcaaatagaaaatcagttaattcgaatttttttttgtttttttccatgtgattcatgggataagaggaatgcttttggaagttcattttgtcaaaggtaacacacctgattgtgcgtgtgattgtaaatccattcaaaaagctcaatgtttatgatcaaattatttatttttgtagtgatgatatatgaaaacttttatggagaacaatgttttaataaaaacaacatcctcactaaattaagaaaagtgtagcagaaatatacctggattgatggtaagatacatgtgtatataattcataatttaaaaattaataaaatatataaaaatattttaagaaaatagtaaataaaagattttattaaaaatgggaagatgtaggtcaaaagacatgaagttgcagttatgaagtacaagtctagaaattacagcacaaggactgtggtcaataatattatatcatatactagaaattgctaagagtagattttaggtattcttaacacacacacacacacacacacacacacacacagagagagagagagagagagagagagagataactgtgtgagatgatggctatattaatttgcctggctgtagtaatcacttcactatacatttgtatattaaaacatcttattgcataccgcaagtacatatgattttaaaagaaaataaattaattaaaatatttaaataaaatatacaagtatataatatgaaatgtattttgtaaaatcattgagtatagaatgtacatataattgataattgtatccaaacgagttgtgatattgtactcttagaattagaagctgccattgtaaaaatgtacagatatttatatctttacacagaatgattgaactacagatttttttcaatactgaagttaaatacaaaaacacacctcactgtgggaagaacacacttgctctctttgcccccgtcattgatcagattttagaaatatgtcagcctttgaaaaacttctttgtatctcactgtaactatgctacactggtaatgagtgtatgaatcctttaaatcttgtctgcatttttgccccaaatcaagtggaaatcttaaaagtattcaattactggagtatcaggaaattcagcataggcaggttttagagacttgccattattaaaaccacagcctgccagctagaagatattgccgtatttcctcacaaaagcagagtagggagtgacaaattataggatgagggcccaatggtaggtacacaaaatttaatttcaaaattgtataatttttccttagaacaactacgttatggaaataattttttcatgagacttctgtattttactggataaatttttattctatatcacaatggaatgaagttgaaaaggcttataatattgcatcatccacatttggtcagatattcaaaagaatcataaagagagacaattaatatgagagcttgatcttgctaaagttttcattaaagacctatacactgagtggaagcagaaagatagttcctttaaaaat

SEQ ID NO: 197 - DNA, 596 bp, Homo sapiens
tggtaatataatagtttctaaactttactgcataaaattggatccaatgctataacatctggaagcgcacatactttataagttgtaaaacatttaaaaaaggtaagaagatgttagtaacattaaatttgttctaaaactacctctcttcctcctgtctaccctaccaccaccaccaccaagaaaaccatcaagacctggtttggggctctgtgaggcagcgccaaaacatagatgccacccaccagattgattgtatggcccgcaacagtatccatactaagacttagtcaatcacaaaagaaagcagagtagggagtcgccaaggacgcagggggcaggttccagttctattgcttatttgttgtgtgaacttaagcaagtttcttaactcagaaaaccctgtttcctcttgtgtaaaaaacaagtattaccttatctatatagaattattctgaggactacatgatataatgaatgcaagcattattaccccaggaagtcatttaacagatttcctttcatttatttttgtgttcatattgtgaggcaaggcagtaggcagtatgactaagaaacaaaaaaaaaaaaaaagg

SEQ ID NO: 198 - DNA, 5651 bp, Homo sapiens
acgcttccatagcaaagggttgcccttggctacaggaggacgcgggctggcaggcttggttcctggcgagtttctaagcccccgcctgcggtctgaggcaccggctgaaccatgtcggagatcctgtgccagtggctcaacaaggagttgaaggtgtcccggaccgtgagtcccaagtcatttgcaaaggcattttccagtggctatctacttggagaagttctacacaagtttgaacttcaggatgatttttcagaatttttggacagcagggtttcaagtgccaaacttaataatttttctcgcttggagccaacacttaaccttctgggtgtgcagtttgatcagaatgtggcccatggcatcatcacagaaaagcctggggtggcaacaaagctgttatatcaattgtacattgctcttcagaaaaagaagaaaagtggactgactggagtggagatgcaaaccatgcaacgtctgacaaatttaagacttcaaaacatgaaaagtgatacttttcaagagagacttagacacatgataccacgtcaaactgatttcaatctgatgcggattacatacaggtttcaagaaaaatataaacacgtgaaagaagatcttgcccatttgcattttgagaaacttgaaagatttcaaaaactcaaggaagagcaaagatgttttgatattgaaaagcaatacttaaacagaagacgacaaaatgaaataatggccaaaatccaagcagctattatacagattcctaaacctgcatcaaatcgtactttgaaagcactcgaggcccaaaaaatgatgaaaaagaaaaaagaggcagaagatgtggctgatgaaattaagaagttcgaagcattaataaaaaaggatctccaagcaaaagaaagtgcatccaagacttctttagatacagcaggccagacaaccaccgatttgttaaatacttactcagatgacgagtacattaaaaaaatccagaagcgccttgaagaagatgcttttgcacgagagcaaagggagaaaagacggcggaaattgttaatggaccagttaatagcccacgaagcacaagaggaggcttatcgggaggaacagctgattaaccggctgatgcggcagtcccagcaggagcgcaggattgccgtgcagctcatgcatgttcggcatgaaaaggaagttttatggcaaaacagaattttcagagaaaaacaacatgaggaaagacgacttaaagatttccaggatgctcttgatcgagaagcggctttggcaaaacaagccaagattgactttgaagaacaattccttaaagaaaagagatttcatgatcagattgctgtggaaagagctcaagctcgttatgaaaagcattattcagtatgtgcagaaattttggatcaaatagttgatttgtccactaaagtggcagactatcgaatgttgacaaataatctgattccgtataagttgatgcatgattggaaggaactattttttaatgcaaaacccatatatgaacaagcctctgttaagacactacctgctaacccctcaagagaacaacttacagaactggagaaaagggacttgctagataccaatgattatgaagaatataagaacatggttggagagtgggccttaccagaagaaatggttgacaatttaccaccctccaacaattgcatactgggccatattcttcacaggctagctgaaaaatctcttcctcctcgagcggaatcaacaacacctgaattaccttcatttgctgttaaaggatgcttattggggaaaacattaagtggaaaaactaccattttaaggtctctacaaaaagactttcctatacagatactttctattgacactcttgtccaagaagctatccaagcatttcatgacaatgaaaaagtcagtgaggttctaccaattcagaaaaatgatgaagaagatgctctaccagttctgcaagaggagattaaagaaagccaggatccacaacatgtattttcagctggtccagtttcagatgaagtattaccagaaacagaaggtgaaacaatgcttagtgctaatgctgataaaacaccaaaagctgaagaagtcaaatcaagtgatagtttcttaaaactcactacacgtgctcagcttggtgcaaaatcagaacagttgctgaagaaaggaaagagcattcctgatgtgctgcttgttgacatcatagtaaatgctattaatgagatacctgtgaatcaagactgtatcctagatggttttccaatgactttaaaccaagcacagcttctggaagaagctcttacaggctgcaatagaaacctcacagaagtggaaagaaaaaaagcacaaaaatccacattggctattgatcctgcgacttccaaagaaatacctcttccctctcctgcatttgattttgtcatattattagatgtttcagatacttcctcaatgagtcgcatgaatgatattatagctgaagaattgtcctataaaactgctcacgaagatatcagtcaacgtgtagctgctgaaaaccaagataaggatggagaccaaaatttaagagaccagatacaacatagaattataggcttcttggacaactggcctttattggagcaatggttttcagagccagaaaatattttgataaaaatcaatgctgaaatagataaggaatctttatgtgaaaaagtaaaagaaattcttacgactgaaatagcaaaaaaaaagaataaagttgagaagaaattagaagaaaaggaagctgagaaaaaagcagcagcttccctggctgagcttccacttcctacacctcctcctgctcctcctcctgaaccagaaaaagagaaggaaattcatcaaagccatgtggcttcaaaaactcctactgcaaaaggaaaacctcaatcagaagccccgcatggtaagcaagaatctcttcaggaaggaaaagggaagaaaggtgagaccgcactcaaaagaaaaggttctcctaaaggaaaatcatcaggaggaaaagtaccagtaaagaaatcacctgctgactctacagatacatcacctgttgcaatagtgccacagccacctaagccaggatcagaagaatgggtctatgtgaatgaaccagttcctgaggaaatgcctttgtttttagtaccttactgggaactaatagaaaattcctatataaacaccatcaaaacagtactcaggcatctgagggaagaccagcatactgtgcttgcttacttatatgagattagaacaagtttccaggagtttctaaagcgtccggatcacaagcaagattttgtagctcaatggcaggctgatttcaactcccttcctgatgacctgtgggatgatgaggaaacaaaggctgaactacatcaacgagtgaatgatctgcgagaccgcctgtgggacatttgtgatgcccggaaggaagaggcggagcaggagcggcttgacatcattaatgagagctggttacaggacactcttggaatgacaatgaaccatttcttttccctgatgcaggcagagctgaaccgtttccaagatacaaagagactccttcaagattattactggggaatggaaagtaaaatcccagtagaggacaacaagagatttactcgaatccctttggtccaactggatagtaaagacaattctgaaagccagcttagaattcctctagttcctcgaatatccatttctctggaaacagttacacccaaaccaaaaacaaaatcagtactgaagggcaagatggataactccctagaaaacgttgagtccaactttgaggccgatgaaaagttggtcatggacacctggcagcaggcttctttagcagtatctcacatggtggctgctgaaattcatcagaggcttatggaagaagaaaaagaaaaccagccagcagaccccaaagaaaaatctcctcagatgggtgcaaataaaaaagtcaaaaaggagccacccaagaaaaaacaggaagacaaaaaacccaaaggtaaatcaccacctatggcagaagcaactcctgtcatagtaacaacagaggaaattgctgaaatcaaaaggaaaaatgaactgagggtcaaaataaaagaagaacaccttgctgccttgcaatttgaagaaatagccacgcaatttcgacttgaactgataaagacaaaagcattggctcttcttgaagatttagtaacaaaggtggttgatgtatataaactcatggaaaaatggcttggtgagaggtatttgaatgaaatggccagtacagaaaaattaactgacgtagctcgctatcacattgaaacatctacaaaaattcagaatgaactttatttaagccaagaagacttcttcattaatggcaatataaaagtcttcccagatcctcccccatcaatacgtcctccacctgtagaaaaggaagaagatggtaccctgaccattgaacagcttgacagtcttcgagatcagttcttagatatggcacctaaaggcataataggaaataaagcatttactgacattctgatcgatttggtgaccctgaaccttggcacaaacaactttcctagtaattggatgcaccttacccaacctgaattacaggaattaacatctttattaacagtcaactccgagttcgtggactggcggaagttcctgttagtaacctcaatgccttggcccattcccttggaggaggagctccttgagacccttcagaagttcaaggctgtggataaggagcagttgggcaccatcacttttgagcagtatatgcaggctggtctgtggtttacaggagatgaagatataaaaattccagaaaatcctcttgaaccccttccatttaataggcaggagcatcttatagagtttttctttaggctatttgctgactatgagaaggatccaccccagcttgactacacacagatgctgctttactttgcttgccacccagacaccgtggaaggagtctacagggccctcagtgtggctgttggaactcatgtcttccaacaagtcaaagcttccattccaagtgcagaaaagacctcctcaactgatgcaggtccagctgaggaatttcctgaacctgaggaaaatgctgcaagagaagaaaggaaattaaaagacgacacggagaaaagggaacagaaggatgaagaaatccctgaaaatgcaaacaatgaaaagatgtccatggaaacactactcaaagtgttcaaagggggaagtgaagcacaggactccaatagatttgccagccacctaaagatagagaacatttatgcagagggcttcataaaaacatttcaagacctaggtgccaagaacctggagccaattgaagtcgctgttctcttgaagcatccttttattcaagacctgatttcaaattattcagactataagtttcctgatattaaaataattctccaaaggagtgaacatgtacaaggaagtgatggagagagatcaccttcaagacatacagaggaaaagaaatgaagacaaaagagtgtgatttttttaattctgcaataaatcttccaaaaattaaatgtgaaaaaaaaaaaaaa

SEQ ID NO: 199 - DNA, 849 bp, Homo sapiens
tgagacagcttctgaatctgttggttaaaaatatttacattaaagttctcaaatacaaaatctatttagtaaattagtcaacagtaccactcagtcaaaagatagttattgaacacttagaatgtgccaatcacagtgctacatagtggagatggatggtaaacaaaatagacatggggaaacttgaaaaggtaattgaaatacaatctgacctgttctgataaggacaagcaagcaccaattacgggatgatttagaagggagactagaactagtcttgacaagtcaaggaagttttgtcagagatgaagcatgagtagggattatttacattactgtaggaagaatcaataacatcctcaaaaactcagaaataaaaagatacagtaattcagtgaactacaagaaataatgcatgacagggagtgagtcgagtacataaaaggaaggatgtgtatagtagaaaatagtttgagggggcagagcaggtaggaagtgtgtctggggcttctggcagccatcccacaccctaaatgtaaagaaacataaagctcagatgatgtcattggttgctaggattcagctatgcatgaaaccaaagataagactctgggtaacacctacatttactacattcacaaagaggcagtgtattcattagcagatatttgttgagcattgtgaatgtgatgctaagtgaaaataatacactttcctcagaaagattactatctggttgtaaatacagagaggtaaagaggcaattttaatacatagtgttgtgataatatacagaaaacaggacaatatgggaaagagagccagggaaaattcaaaaaaaaaaaaaaa

SEQ ID NO: 200 - DNA, 3345 bp, Homo sapiens
cagatgtccagttccagatgcctggacccagagtgtgggggaaatatctctggagaagccctcactccaaaggctgtccaggcgcaatgtggtggctgcttctctggggagtcctccaggcttgcccaacccggggctccgtcctcttggcccaagagctaccccagcagctgacatcccccgggtacccagagccgtatggcaaaggccaagagagcagcacggacatcaaggctccagagggctttgctgtgaggctcgtcttccaggacttcgacctggagccgtcccaggactgtgcaggggactctgtcacaatctcattcgtcggttcggatccaagccagttctgtggtcagcaaggctcccctctgggcaggccccctggtcagagggagtttgtatcctcagggaggagtttgcggctgaccttccgcacacagccttcctcggagaacaagactgcccaccttcacaagggctttctggccctctaccaaaccgtggctgtgaactatagtcagcccatcagcgaggccagcaggggctctgaggccatcaacgcacctggagacaaccctgccaaggtccagaaccactgccaggagccctattatcaggccgcggcagcaggggcactcacctgtgcaaccccagggacctggaaagacagacaggatggggaggaggttcttcagtgtatgcctgtctgcggacggccagtcacccccattgcccagaatcagacgaccctcggttcttccagagccaagctgggcaacttcccctggcaagccttcaccagtatccacggccgtgggggcggggccctgctgggggacagatggatcctcactgctgcccacaccgtctaccccaaggacagtgtttctctcaggaagaaccagagtgtgaatgtgttcttgggccacacagccatagatgagatgctgaaactggggaaccaccctgtccaccgtgtcgttgtgcaccccgactaccgtcagaatgagtcccataactttagcggggacatcgccctcctggagctgcagcacagcatccccctgggccccaacgtcctcccggtctgtctgcccgataatgagaccctctaccgcagcggcttgttgggctacgtcagtgggtttggcatggagatgggctggctaactactgagctgaagtactcgaggctgcctgtagctcccagggaggcctgcaacgcctggctccaaaagagacagagacccgaggtgttttctgacaatatgttctgtgttggggatgagacgcaaaggcacagtgtctgccagggggacagtggcagcgtctatgtggtatgggacaatcatgcccatcactgggtggccacgggcattgtgtcctggggcatagggtgtggcgaagggtatgacttctacaccaaggtgctcagctatgtggactggatcaagggagtgatgaatggcaagaattgaccctgggggcttgaacagggactgaccagcacagtggaggccccaggcaacagagggcctggagtgaggactgaacactggggtaggggttgggggtggggggttgggggaggcagggaaatcctattcacatcactgttgcaccaagccactgcaagagaaacccccacccggcaagcccgccccatcccagacaggaagcagagtcccacagaccgctcctcctcaccctctacctccctgtgctcatgcactaggccccgggaagcctgtacatctcaacaactttcgccttgaatgtccttagaaccaccttcccctacttcatctgttgacacagcttttatactcacctgtggaagagtcagctactcacccgctattagagtatggaggaaggggttttcattgcattgcatttctgaaacattcctaagaccctttagttgaccttcaaatattcaagctattctgcagctccaagatgcaattatagaaacagctccttttttattttatgtcctctatatgccaggtgcttcacctgttatttcacttaatcctcataccatatttgcaaaggatgtgttattatctatgtgtgacaaatgaggaaactgaggctcaggggataaagggacttgcccaagtcccacagctggtgtgtgactgcagagactgtgctcttcccagtgtgctgcaatacttctcaaccctcctctaacctgctgtgtcacccgctttccctcccagcccccacatccttaccattttccctccctgggaattcctgcttctgcgaaaatggtatcctctagctcacactttcctaatggccccatctcctgcagaagccaggtgagcccagcactggactgaagttcttgcagacaccccacctgtgcccctatcatcaggggaactgctccacctgagaggaccaactctttaatttttagtaaaacctgaaggtgatgggccgggcgcagtggctcacgcctgtaatcccaacaccttaggagtccgaggtgggtggatcacgaggtcaggagatccagcccatcctggccaacatggtgaaaccccatctctactaaaaatacaaaaattagccgggcgtggtgacacgtgcctgtagtcccagctactcgggaggctgaggcaggagaatcacttgaacctgggaggcggaggttgcagtgagctaagatcacgccactgcactccagcctgcggacagaccaagacttcatcccccccaaaaaaaaaagattggaggtgatttacagtgaaagacacaaataaaatacaactgttcaatggaaatagaaaataaacaccataaaagagagaagagaggtaatttgttagcatcaagagtcaagttgctatatggtcaaaggttaaatttatctctaaaaaatggcaggattcaaagttgtacatacatgtgattacttctgttttttacacccacatacagtacaaaagattattaaaaatattcccaaaaggcaggtgcaatgatgcacacttatacccccagccactcaggaggctgatgcaagaggatcgcttgagcccaggagttgaagtccagcctaagcaacatagtgaaaccccatctccaaaaatataataataattctctcaaaatactaaacagaggtggttttattgataagattttggctgtttggttttccactattctctattggctaaaatttgtttaatgagcatgaaatgtttttattttattttgcttatttttatgattgcaaaaaatgatatgagtttctccctgccaaggcaaaaaatatatatatatacctataaaaaaaaaaaaaaaaaaaaaaaaaaa

SEQ ID NO: 201 - DNA, 1500 bp, Homo sapiens
aactgtagtaaacaaagccattcctctcttctatcttgtggccagagcactgattttgttcacaaggggtgtgggaggtgggtctgtcctttcctaataggaaccaggagagagcaattctattcttagccccagggacaaatccagatgctaagataaacatggtggcaccatttctcttgcaagcaactgcattaggcccagtgctggccaataagacgtaaggggaaatctgtttaagaggcttctggaaaaggatccttaaaataatttttaaaagactctcaaaagaaagagatgggatactgaacttgagttggaagacatgagtccagttgtctggtctcaaaatggaggtaaaaccgctgcccaactgcagccgttgccaccactgtgggggtggggtggtgggggagaagggccatgattcaaaggaaccagagcttttgcaaaaactttttactggtggtctgagctttgaaactacagatgatagtttaagagacattttgagaaatggggcacactcacagattgtgtggtaatgagaccccaaaaaacacgttccaggggctttggttttgtgacttactcttgtgttgaagaggtggaggcagcaaggtgtgctagaccacacaaggctgacaggtgtgtagtggaaccaaagagagctctttctatagaggattctgtaaagtctggtgcccatctaacagtgaggaaaatttttgttggtggtattaaagaagaaacagaagaatataatttaagagactactttgaaaagtatggcaagattgaaaccgcagaagttatggaagacaggcagagtggaaaaaagacaggatttgcttttataacttttgatgatcatgatacagttgataaaattgttgttcagaaatgccacactattaatgggcataactgtgaagtaaaaaaggccctttctaaacaagagatgtagtctgctggatgacagaggtcacagaggtagatctggcaattttattatggaggaaactttggaggtggtagaggtagttttggctgtggtggaaactctgatggaagaggaggctatggtggtgaaggtggtggcagcagaggtagttatggaggaggtgatggcggatataatggttttggaggtgatggtggcaactatggtggtagtcctggttacagtagtagagggggctatgatggtgatggaccaaggatatggtggtggtggtggagtgacggtggagtgaaggaggaaattttggcggtggtaactacggtggtggtgggaactataatgagttcggaaattatagtgaacaacagcaatcaaactatgaacccatgaaagggggcacttttggtggaagaagctcaggcattccccatggtggtgaaagtggtggatatggtagcagaaggttctaaaaacagcagaaaagggctacagttcttagcaggagagagaacgaggagttgtcaggaaagctgtag

SEQ ID NO: 202 - DNA, 1951 bp, Homo sapiens
attcaccactgctgagcagaacagtcagggtgctgccctcagggagttaccatgtagtaaaggagacagatggaatcacacagaggaatgcacgtctgattgtagcctgactggagtgccatgaaggagaccaagagggcagggtgatggagaaagcacaggatgaagttctcgtcttccttccaacagaatctcagttgcactcagttgttgcccccctcgaacctcccttgagcctcaggagaaaccaccctgattcagaggtccagagaagacctgactagcccaaggtaattccgtccccttgccagagtggcttgggcagggacacgggacctatttcaatgaggccaatgagacaaaggtatttctgctggggaggcaggggcttcaagcaaagggtcttgcttgaaagagccaccggaagagggctctctccttccttagggtgtcaccgtgtctggatgcgatgcctggaagtgctacagccactcgcgcccagcctgaagatgaaaccaaccccaaacacagccaagcagagagatggaaagaactaggaccctaattacaccactgagcagctatagcaaccagttccagagccctctgacttcccgccaaagtgagatgataagatactgtttaatttctctcttttatagccaaacacaccaaaattgacacagagatgtgagccatacctactactgttactgctccatccctagctccaaccacagtgcatggtacatggtagagagccaacaaacacttgaagaatgaatggtgcatattgagtgggattttccagaggcagacctggagacaaggcttcaagtgcgtgtgttgtattaaggaaatgctcccaggggacaatagcagagtggcagaaatgggacaagggggccagggagccaagaacagagaatcaatcgtctaaacagagccccctgttttttgtttcacctgggagtagcttctacctgatccccaggggaactctgggatgtcagtgacggctcagcattgcccctgaggcaagggagctgggctttcctaatcccccactcctcagtctctggctaagcgctgtccccaggggacttaatcacccaaacacttccccaagagtggcatctgctgaccactggaggcactggtacagtgaagcgacagaagggatcagagagggtccaggtggagcacagcaatgtggctgaataataactatattaattcatatagttaattctcaagcaatggcaaagtgtaggcagcttcttgtctgcaaacgtttccatgatatctctcctgcagccagacgggtcttttcctgccgcctacacagaatggccatggagcatccccaactcttattaaaatggaaaaaaaaaaagcctttgcatttcaatctattattgcactttatgactcatcttcaggttctctctgcaaaacattgaaagccagatcataatttgatgatgaaatattgattatgcatttgtatgcagaggtctatactatatagatagaattcccaccctgtagtatcttctattttaagtcagtatgaagatggatgttccccccaggcaaattttgataagatacttgtgtcaatacaaaaagagattaatgccaatgtgaatcaatacccgcttattggtttgggttgcttcttctccacgcagcagctggcaccaagaggggtttccaaacaccagcggctcccagccaatctgcatatttctttatttaaatcatgagagtgggaagtggcaagggaatggtgggttggcagggggctgcccacgcccactcccaaattgagaagggaatgaaaataaagcaaacgcaacttgtcaacaaatctgggagaagctttattaccatcattagcagtgtgcttgtcctctgctgcttccaaaaagaataaacttcaaatgac

SEQ ID NO: 203 - DNA, 575 bp, Homo sapiens
ttttttttttttttttttttttggctctagcgggggtccccggggtgattcggttattttaattaattttttcaaattcagttcccagggggtaattagcaggtgcacaaaggcaaaagaagattctgggaattctgcagataagtgactttgccatttgtggaagagtctagataaaaatgacaagtttcaatgattcaagaaaacaaaaacaaaacaaaacaaaaaactctaaaggcatcatccaccaggcctcgattcattggtactttcaattaaagaaacaagaagagagatcacacctccagtatgagatttatgataatggatgagggtaaaacatttaatgtagcatcaactttttttgtaacattaaaaataaaattaccaggtttatttatggaggggaagcaggataaatgccaccaccaccctattctcatgaatagccacactcacttgtgatctgactactaggccaacttctgttgctgctgaccttgaggtgtctgccctctgtccaaaaggtaatccagttgtttgaggctggacttttagctagaacagacatggtg

SEQ ID NO: 204 - DNA, 12436 bp, Homo sapiens
gtattgatgtcaagctgaaccatcgtaggaagttgaaagccttagaaagaggacttggtaaagtttttggattatcttgaaactctggcaagatggccaagtatggagaacatgaagccagtcctgacaatgggcagaacgaattcagtgatatcattaagtccagatctgatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgaagatgttgccgttcagcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacagagtacagcgcctgaggaggagcatgagagtccccgagctgaaactcccagcactgtcactgaggttgacatggatctggacagctatcagattgcgttggaggaagtgctgacctggttgctttctgctgaggacactttccaggagcaggatgatatttctgatgatgttgaagaagtcaaagaccagtttgcaacccatgaagcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaaagtttgcaaagtgatcttgaggctgaacaggtgaaagtaaattcactaactcacatggtggtcattgttgatgaaaacagtggtgagagtgctacagctatcctagaagaccagttacagaaacttggtgagcgctggacagcagtatgccgttggactgaagaacgctggaataggttacaagaaatcaatatattgtggcaggaattattggaagaacagtgcttgttgaaagcttggttaaccgaaaaagaagaggctttaaataaagtccagacaagcaacttcaaagaccaaaaggaactaagtgtcagtgttcgacgtctggctattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtttgatgctataagtgcagagctgttgaactggattttgaaatggaaaactgccattcagaccacagagataaaagagtatatgaagatgcaagacacttccgaaatgaaaaagaagttgaaggcattagaaaaagaacagagagaaagaatccccagagcagatgaattaaaccaaactggacaaatccttgtggagcaaatgggaaaagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatgaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggccgattcaacagtcattgagaagtggatggatggcgtgaaagacttcttaatgaaacagcaggctgcccaaggagacgacgcaggtctacagaggcagttagaccagtgctctgcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggaggtctggtcttgttggattgaactgcttcactatttggatcttgaaactacctggttaaacactttggaagagcggatgaagagcacagaggtcctgcctgagaagacggatgctgtcaacgaagccctggagtctctggaatctgttctgcgccacccggcagataatcgcacccagattcgagagcttggccagactctgattgatggggggatcctggatgatataatcagtgagaaactggaggctttcaacagccgatatgaagatctaagtcacctggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcagaaaatccaagcagagatctcagcccatgagctaaccctagaggagttgagaagaaatatgcgttctcagcccctgacctccccagagagtaggactgccagaggaggaagtcagatggatgtgctacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatgaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaaaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatgaaccatcagaaccagctagaaatatttgatgggaacgtggctcacataagtacctggctttatcaagctgaagctctattggatgaaattgaaaagaaaccaacaagtaaacaggaagaaattgtgaagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaattgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaagatggatgaggagagtgcccagattgaggaagttctacaaagaggagaagaaatgttacatcaacctatggaagataataaaaaagaaaagatccgtttgcaattattacttttgcatactagatacaacaaaattaaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacattggcacagaatttgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgataaccaaatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagagccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccttcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaactaatcacagactatcatctaatctggttacatattgtatttttcatcctgaataaaagtaattttaacacaaaaaaa

SEQ ID NO: 205 - DNA, 456 bp, Homo sapiens
  misc_feature (432)..(432): n is a, c, g, or t
attcccaatccacccggcagcccagcctgggaccacaggaacccaaacaccagacgtgggcccctcagcatgatttccatgaaacttaatagatgtgtttccattccttcccagtgaacacagcccgcagcccgcctgggccaggcaggagccaggctgttcccaggcaggagccagcgggtgtgaggctgaaaaggaagaaggacacatgtgcttccaggcagaaggatggacccccaccacccatcagacacagcctagaattatctgtggatgaacctgccttctccatggactgccagcccccaaagcaggaaccacgtccttatagagggcctggcacacagtagggaactggggtggggtactgccatgcagcaggtatgtgggcaatgttgaatggattaaactgaacttggctagggtggtggnttatgcctgtaaaccatgcacttt

SEQ ID NO: 206 - DNA, 1884 bp, Homo sapiens
atgccgcgcagcccaacatccagcgaggacgagatggcccagagcttctccgactactccgtggggtcggagtcagacagctccaaagaagagaccatctatgacacgatccgggccactgcggagaagccgggcggtgccaggacggaggagagccagggcaacacgctggtgatccgcgtggtcatccatgacctgcagcagacgaaatgcattcgatttaacccggatgccacagtgtgggttgcaaagcagcggatcctgtgtacattaacccagagtttgaaagatgtcctgaactacggcctgttccagccggccagcaatgggcgtgacggcaagttcctggatgaggagcggctcctgcgcgagtacccacagcccgtgggtgagggcgttccttccctggagtttcgatacaagaagcgggtgtataaacaagccagtctcgatgagaaacagttggccaagctccacacgaagaccaatctgaagaaatgcatggatcacattcagcatcgcttggtggagaagatcaccaagatgctggaccgaggcctggatcccaatttccacgacccggagaccggagagacccccctgaccttagccgctcagctggacgactctgtggaggtcatcaaagctctcaaaaatggtggagctcacctggacttccgtgccaaagatgggatgaccgccctacacaaagctgcccgagcgaggaaccaagttgccctgaagacccttttagagcttggtgcatccccagattataaagacagttacggcctcaccccgctgtatcacacagccatcgtcggaggtgatccctactgctgcgagcttctcctgcacgaacacgccactgtgtgctgcaaagatgagaacggctggcacgagatccaccagattctcagtgataatgtgaagcaactttgccttcgcgagcctcctctcattcatctgcagggcccttgtgcctatcagatgataagggacggagcagataagggatgggtgcgggtgccctgcacgggcctgcaggagcagcggacacacctggagaatggacagccctgtcccagggttctgggcgttcatcgtgtgggagagcctgcgcggccacagccaggcctgctcacagatgctgcaggtgtactccagggttccccaggccgctgctttcccatcattgtctcaggccagacttttacatccaccgtgcaacttcacagcacgctggccctggccacagggggtgtggtcctggagaggatgccgcttggctgccccctgcccatccctggccggatgccctcagctcttgagcctctctgggccccacggcgaggggacaggcccctgatcctcccaggcctgtgggaggttctttgctggagccccatgttatgtcgttctgggtccaagctttctggttaccttcctgccaggccttggaactgggaccgagcctcactgtgggacgtgggtgctggcaggtactgcacctttccagatgagcacctccagggtgtgagagtgtggggtccctgccaggtggcaggaccagagcacgggagcccttccccgtgtcactctggacctggggctcagggtctgcccctgggcacgagcggccgagcctctgtggcccccgtgtctggagccgcaacagaatcagctgcttctccaaggagcctgattctttttagtgtggagtggtatttagaagtcaaggtgcaggtgcttggggtgctgatggctgctgggctgttgctggtcctgcaccctctcagcctgcaggtacgggcacgtgcagcacctggagcacctgctgttctacgacggccttgcacatctgcgccctctacaaccaggtga

SEQ ID NO: 207 - DNA, 521 bp, Homo sapiens
tttttttttttttttttcagcaaaaagaatattcaaaattaaaaactcttataaaataagcagtctatttgaactccagtcataaactgatcaccaaaaataacgtgagcccaccttgcagacacaatgctctcaaaagagtaatttttttttttttgtccttcaaaatacagccggctcagaaagtgtctgaagaagcagttttcctggctttttgataaagacggtggacaagaatgggcgtgagaagaaatagttgttaggtcttccttagtaaggatgggcttttgtccaagtctatgtgactgtgcaggtgcaggggttttgtctggaggtgatcagtgctatcagtctaatgtcttcctgggctacatttgagtgaggcaatgacaggaagcctgtcccttcaagtccctaggcaagaaggggatgctgcatacaaggcctgttctaggcatactccatgaatttctcccttttatcccccatctactaacatttggtctcactgtgcttaaagg

SEQ ID NO: 208 - DNA, 539 bp, Homo sapiens
  misc_feature (535)..(535): n is a, c, g, or t
tttggaacggccctcatgtttatttcctcattattttgattccgagcttttgcaaattgaggactcagcagaatgaggattaggcaattttctttcctcctgtaatgtactttctccaaattgcttcttttgagacaattatttgaggcctttgaattgcttctgtgggcaggctgagggagtcagacagcacatcttcattttcacaggtcttagggctttctcccttttcttctcttaatctgcctttggtctgttgattttcagtgaacaatcagagagtaaaggggaagttttcctctgccccctacacttttctggcttccaaggctcagctggaatcaggaagaaggtggtcgttggtgggctggccctgtggagatgtctttcttcagtgagcacctgcccaatccccttcctcattcccttcacacacctggctttgtggtcacctttccctgcatgttggtccggcttgtcctgtcaggctgtgtcatgctgaagtataagcagctccggaaataccccattgtgntctg

SEQ ID NO: 209 - DNA, 3887 bp, Homo sapiens
agaccgccgctgctgtctgcggggtctggtgccggggcctgagtctctgctggctaagccgacgcctcagccgcctcagtcgcctcaatctcgccttccgccctcgctctccctccgcgccaccggaccccgtagccccgcgcgcccccagacctttaagccagatgatgaacttcctgcggcgccggctgtcggacagcagcttcatcgccaatctgcccaacggctacatgaccgacctgcagcggcccgagccccagcaaccgccgccgccgccgccccccggcccgggcgccgcctcggcctcggcggcgcccccgaccgcctcgccgggaccggagcggaggccgccgcccgcctcggcgcccgcgccgcagcccgcgccaacaccgtcggtgggcagcagcttcttcagctcgctgtcccaagcggtaaagcagacggccgcctcggctggcctggtggacgcgcccgctcccgcgccggcagccgccaggaaggccaaggtgctgctggtggtcgacgagccgcacgccgactgggccaagtgctttcggggcaaaaaagtccttggagattatgatatcaaggtggaacaggcagaattttcagagctcaacctggtggcccatgcagatggcacctatgctgtggatatgcaggttctccggaatggcacaaaggttgtccggtccttccggccagacttcgtgctcatccggcagcatgcatttggcatggcggagaatgaggacttccgccacctgatcattggtatgcagtatgcaggcctccccagcatcaactcactggaatccatatacaacttctgtgacaagccatgggtgtttgcccagctggtcgctatctataagacactgggaggagaaaagttccctctcattgaacagacatactaccccaaccacaaagagatgctgacactgcccacgttccctgtggtggtgaagattggccacgctcactcaggcatgggcaaggtcaaagtggaaaaccactacgacttccaggacattgccagcgtggtggctctcacccagacctatgccactgcagagcctttcattgactccaagtatgacatccgggtccagaagattggcaacaactacaaggcttacatgaggacatcgatctcagggaactggaagacgaacactggctctgcgatgctggagcagattgccatgtcagacaggtacaaactgtgggtggacacctgctctgagatgtttggcggcctggacatctgtgctgtcaaagctgtacatggcaaagatgggaaagactacatttttgaggtcatggactgtagcatgccactgattggggaacatcaggtggaggacaggcaactcatcaccgaactagtcatcagcaagatgaaccagctgctgtccaggactcctgccctgtctcctcagagacccctaacaacccagcagccacagagcggaacacttaaggatccggactcaagcaagaccccacctcagcggccaccccctcaaggttgtttacagtatattctcgactgtaatggcattgcagtagggccaaaacaagtccaagcttcttaaaatgattggtggttaatttttcaaagcagaaattttaagccaaaaacaaacgaaaggaaagcggggaggggaaaacagaccctcccactggtgccgttgctgcgttctttcaatgctgactggactgtgtttttcctatgcagtgtcagctcctctgtctggttgtttacctgttcctgttcgtgcttgtaatgctcacttatgttttctctgtataacttgtgattccagggctgtttgtcaacagtatacaaaagaattgtgcctctcccaagtccagtgtgactttatcttctgggtggtttgatagtgtttttaaaagtaatatataatgtggggtgaaatgggagtaggggggtggacaggggagaaacgaaaaccacaaaaagaaaacccaactcctctcctccccccaagctcagttaaatcccccacctccaactttccctccaccagtgtgcttgggatcttcaatgaactgtgcttttcgctttctttctgcatgactattgtaactagatagaacattaagagattttcaagatcaaacttccatagcttcatccactgaatttgaaggcatccacctttttctccatttgctaaaatttggtgcagtttgagtttatgtgaataggctggctgtgcctgtagagctcttgtgtttttagtgatgacatgaaatacaaagaacaagctatttccaggaatgtgttctgtattttacatcccagtgtaccctttattttattattaactaattaactatgagatttttaaaaaatggggccgctgatgtgcaatatcaaagtgaacttgtgagtattttgtgtgtgttgatctcagttgtttcttcattgttgctgtttctggatccagccatgtgtgcgcttgtgtggacctgaggctgctttctgttcccaaagcttgacctgtgtacagagataattccttggcaatgttggacatagaatgcagggagctactgaaggtctgtcagggatttgtccattctgctcttggcctctcctgaggcctcataatgggagaccaaatcaaaaatgtcccatgtcacttgagtgggtacactgcctacagaaccttgaggttgactcctgcttcagttctcagctgtttaccacagccctccagggtccaaagattgaggagctttctctttcctgggaggaactgtctcagatttagcttgtgtgtgttttggacagaggctccacagcggtggctcttgaggaatcctcaccagtttgttctcttccctctgacaagcagcacctgagcagatgctgaggcagttcattaaaccaggcctcagcttcagtgcctcatcttgccatctcccggccaggctgggaacgggcaccaagcagccgcctctaacaaacaccatggtccgtggaagttcatgccagcagcttgcctttgagaagaaatgctgctggctctatttttacattcccttccacctctatactgtcatgtcaccgttctgaactcccagatctgagaaggaactagtgttggtggtatgtaacaagagttacgtatccaggggcttgtgccttggtttctcctttgattgctggtaaattctgaggccacagagaaatgcattgagtgtgaatgttgtcatctgtaatccctccctcagctgataatggtagttgatctgttgtaaatatatacatatatgcatatttgcacttccagatgggttgcataagaatcaggtccttaaatacctcccaatctgatgaaacgatagaataaagtaacatttcccagaatggaggaatacattattttatcgtatatttttgtccaagcgatgagctgacggtggtattgcttctctgcatgttatcagtgtgtacatctggtgcttttcatgtgtcatttgtgagccacaaatgcaaagttgccatttgaattcagtcaggctacagggtggtgtcagtcaaggtctttcaggtgggggagaaattggttagggctcccactgccaaatgcaagcagatagcataacctgactgttatgtgccctcaggcagcatgcttagggacaactctgtggcctgggggacatctgtgtcacagtataggattgccattcaggtgttttgtacctatttctttcctgacgttgtcccctttttttgtactgatccaactgggagaacctcagccaatgctggaagtatgattgaagtacctctcttttgtgactcttgtacagcttaatgtgcaataaaggaaaagttatatctg

SEQ ID NO: 210 - DNA, 342 bp, Homo sapiens
ttttttttttttttttttcaaattttatttttaacaatgttaggaggaggaggtacacattctccattcggccctgctgagcttgagctgtcgggcaggctgcaacctgaggcttctgactgcagccctgcagtggggcgctgtgagggtggggcggaggagccacaggacaccagagcatctgctacaaccccagccaagatggtgcagggtccccttccctgagccttccggtctccatggcgacgcctccaaacagcagattccaggcggcaatgacgtcatctctccctttcctgccgcccaggccttggaggtactgctgcctggggccgggggtgg

SEQ ID NO: 211 - DNA, 980 bp, Homo sapiens
ctctagaaacatttacagttactacagaggaactttaaaacagtttaagcaataaatacaagaggactaaaaaacacaaaagtttttacaatttctaacagactgcatcaattggcaaattgattccatttatgattgttaaaataggtgaataagattagatgacaagataacaaaaaaggaatacgttatttatttgtttatttcagacagagttttgctcttgttgcccaggctggagtgcaatggcatgatctgggctcactgcaacctctgtctccctagttcaagcaattctcctgcctcagcctcccaagtagctgagattaccggcatgcgccaccacgcccagctaattttttgcatttttagtagagacggaatttcaccatgttggccaggctggtctcaaactcctgacctcaggtgattgacccgcctcaacctcccaaagtgctgggattacaggtgtgagccactgcactgggccaagaataagatttttaaaaacattttcgcatctggaggctccagggggcttccctgagaaacggcagcctctgcggtcagagaggctgcaattcagagcgttcccacaaacagcaccatgtgctcatgcttacctgcttgggtgtgtgagtcacctggagatggggtgcagaaacattgacatacctgagctatctttcttcctctgccctttgcaggtgtttgatatacagaggaaagtcacctataggaacctgagcacctggtatacagagcttcgggagttcaggccagagatcccatgcatcgtggtggccaataaaattgatgcagacataaacgtgacccaaaaaagcttcaattttgccaagaagttctccctgcccctgtatttcgtctcggctgctgatggtaccaatgttgtgaaggtgtggttgactgcagaggtagctagcaaggtcagggcgctaggtggtaaagggaagctgtga

SEQ ID NO: 212 - DNA, 1662 bp, Homo sapiens
gggatcattgtactttctcatgagttaaactttttatcattatgataatgctttttgccttaaagtctactttgtctaatattaatatagataacattaattttgttaatatttatatttttccactttttaatttcaacattataatacaaatgttttaggtatgtttcttataaacagtatgcagattgttatccaattcaatctttgatttttaattgaactatttaatttatttacatttaatgtaattactgatatatttgaatttaaatataccgtcttcttaagtgttttcaactgtctcacatgctctctgttctctttatcctcactttttgcctgcttttggaaaatattgtttttgcctccattgttttggaagttacatatctttttagtagtcttttagagtttatcctatagatcacagtatgggtctctgagttagcaaaggctaataatgttaattggcactttcattttcttccataatagtacaaggaccttagaacgtttcaattcatttacttcctctcctgatttgtatgcacttttaatatttttaattttttaaatcttcagcactgtgttacattgtttcatacggtataattcatttagacttcctcaaatggaccttcgtgctggacctcatttctttctgcatctatataacctatcatccttaatcatcttccttctgcttaaagaacatcctttagtatttgatgctggtaaagaatcctgaaaatgtcttaatttcacttttattattgaaggctattttcactggacatagaattctaatgttgacagttattttatttcagcacttgaaagacatttaaattccactaatttctagtttccattgtttctatcaagaggtaagctaacagtctattacattttttcaagtaatgacagctgcttgtaatttttttttccctttgtctttggttttcatctgtcttattgtgatgtacctaggtgtggctcttaaaaatttctcctgcttgcagctcccagggcttctgagatttgtggcttgttgtctttaatcaattttgggaatttttcatctattttctcttcaaatattgatgctgcaccattctctttctcttctccttctgaaattttaattctcattttatctccatatctcttactctctgtagcattgctatccttttgtctctccatgtttcgtcatgatgttgtcttctaacctactttccagttcatcaattttccctacagctgtgtataattttttgttaaaccaagtaaagagtatccactgagctctttgcttttgttagtatatattttaaattctaaattgttcactggttattttttacaactttttcatccttttttaaagttttcagttctctgccaaatttgttgatactgtcttttatctccgtatgtgtagtaaacataattaatttaaagtccgtatctgataaatccattaactggagttctgtggtattgtttctattgtagttgtttctactggatctcatgttttcttatttctttatgggcctggttattctcttgtgtgctaaaattgtatatgaaaaattgttggttgaagtaaagtaaaacttattgtgttatattcaaaaaaaaaaaaaaaaaaaa

SEQ ID NO: 213 - DNA, 465 bp, Homo sapiens
tttttttttttttatgttatgttctttaatagagcagtccattttaattggttgggtttttcctttttcaaaacaaccagctcacaggtgtccacacaatactgaaaaatgaaagtattttctaaggtgatgagggggaaagtaattaatgtgggcatagtatagtctaatgttgttctcggtgggttgcagcatcttcctttatgcatctcttccatctggctctttgtatcctttctttataataaatgagtagaggtaaataaagtgtttccccaagttctgtgagctgctccagcaaattaatagaattcaaggtgggggtcattggaagtccaatttatagccagctgatcaggccacagcctggggtttgcagtcggcatctgaagttgggcagtcttgtaggatcaaacctgtgggatctgatactatctcctcataagccaaagccaggagataggt

SEQ ID NO: 214 - DNA, 1381 bp, Homo sapiens
agtctcattaaaaattattgtagagaacttttacttattgcaaacacaacctacgccagaagaaatttcaaaagcgacttaatgaaaatataaaccaacacctgatctaactgtgctaatgaaatctgtgaaaaaacaatgccaccacgtttcaacattagccagcacacccaacatgaacatctactttccgttgaaataaacgtcaaaggctgtcagctgctacaccttccaaggcaaattggaagccaaattctttctagagtttggggtttttatgagttgatacgggtgccaaatcagggaaaaaagaaacaaaaggaagcaggtaagaccccttttaggagtccctaaaaaatatcactgctggctgctgcaacaaatgttttgaagacctaagttcaccacaagccttatttatttctggtggcgatggtggggaaggaggagagtaagcacagaaaattattaaaaggtaagaggaccttaaagttcatctaactcaacgccctcctagggtaagggttcccagtaccccaaaggttcttttttccagggcatgagctgcaatacaaccaaaaataaggggtagcgatggcgaagaaacgggagaaagacgatcttctgatcaggcccgtcgacggttgcagcgttcccccaagacgccaagagcccgccagtccctccgcccctctctccccaaaccccagcctcggctgaggcgcgcacgcgcagcaagtaggggctgcgcgtggcgacgcgcaggcgtaaagtgggtagaaacaataagctttgttgccgaggcggtgggaggggggcaggggaaagggtacccggcggagggataaaggaccgggagaatgaggaacaggagaaagtgctatcccggcaaccctcgcgccactgaggacccggatagagagctgcgagatccaaatcattaataatgacaatgaaaaaaaagcgacggccatgtctcggagaagacagagacgaagtcggcccaagctcatccctcagacttggtggaaagaggcaatgaacaacggaggccgcaatggactcggtggccaaccacccagggaaccctttaggcccctctgccgtcgccgacttgctgtccctcgacctccgcacccctgtcgccactctgcccgagaggacccctcacccaatgcacagcagcggggacggcagccaacgaatcctgtcggcctccgcggatctccacaggcagcgccgctcccccgctcgacgtgcgcttcgcccgccgcctcccttctccagtccaaacaaacaccccagcccggaagtgacttcacttccgtcgccgccaaccccgccctcttgttctgtcagctctgccctccgaagccactag

SEQ ID NO: 215 - DNA, 521 bp, Homo sapiens
tttggttgttcttagtttcttgtccacagcatttatgacatttgagaacaaatactgggctgaatgggacttctggtttgtatattgcaccttatttggtggctcaagatgtctttttgtgacaccactcatacaaaagtatccaagtgatctgtctttgataaagactgttgaatagcaagtgggctacaggtaatcagtcaatagagctggagtgaagacagagtgaactttcaagagcagttaagagttcaggttattttcctcctttccactttaaatacttcacctccttcacatggtcctctcttatctcaatttctctcccattttgtttctttctctcccacatctcctttgttacctaatctttggggtggaaaatgaatctacaagaggtatcagaattcttctttgttgtaatctgtccaaaaggttttctgggtttttatttttactttcatgttaactggagctgtccttagaattccaatgagtaagcttttcagtcccaaactcga

SEQ ID NO: 216 - DNA, 558 bp, Homo sapiens
gccgaggattccaaagatctttgagcatcacctcagtcaatttaaaaagaatgatccagatatacatcatccagcattattaagaagccaacacatctaggctctaggtcagacatgtcttagcagccaatattgtatcagacaaaccaccatttcacatacatccatttgcacatttaaaaatgagagcacagttaacatcatgctggattgttaccacagtcccatatctacctttcagagaatcaaacagtatgacacacataaaattcctttgtaaatcagctctattaagagtgaactaacttacttctaactgggaaaaagagcttgcagtatggacacaagaaaccaggcaggaaagaaagggaggtgggggtaggatcttgcaatgaagaacaaacccagctatgttcagcttgctatgccacttctatgggccacaggaaagtttcacaataagagataaataaacaattcaattttttccactttatagcacaactgaaagcaaaaccaatacagccctggtgatgctcaaagatcttgggggtaccg

SEQ ID NO: 217 - DNA, 221 bp, Homo sapiens
gaattccacgggtatacagtcataaattgcaatttaaataaaagcgtttcagtgcctacaagacccaggctccaaattgagggctttggggtgatggggatcttcttctgcttgtttcttttttacttaaaccacattggaaggtaagaattttcaggaggaaaaacattgtcttacttccgtgttgcccaccagctctgtattttagctgaacttctaca

SEQ ID NO: 218 - DNA, 458 bp, Homo sapiens
ttttttttttcaggagggataagattggaggaaaggggagcaataagcaaatgttctcaacactctaagtagagaatgatgattgatgatggaggggagtaccagggcagattgtggagctaatggattgaaaatatttggattgaaaacctgggacaattagcatcttgtatttagcaagtagcaagcagcactgagaggtccccttttccactattagtggatttactagctctccttagaaggctcactgccactcaaaaaaatacattgcatagatttttaaaaaccaatttcagttaaacttgaagagaaaaacagtattctaatccatgaggatttcacttattctaaaaccacaacacacatacacacacacacacacgaacctattattacacttttttctagaaaacatggtttttatttggctttattttggctccagccctcgtgcc

SEQ ID NO: 219 - DNA, 2795 bp, Homo sapiens
gcgcagatccaagcccagtcccatccccgcggcctcatcccaaatcccgagtggacgtggttatagcctgggctaggtttgtttgtttggttggttggtttttctttcttttcttttttttcttcgtgacagagtctcgctctgccgcccaggctggagtgcagcggcgcgatctgggttcgctgcaacctctgcctcgcgaattcaaacgattctcctgcttcagcctcccaagtagctgggaccacaggtgcgcgccaccaagcccggttaagttttgtatttcagtggggacggggtttcaccatgttgcccaggctggctttggactcctgggctcaagtgatcggcccgacacggcctctcaaagtgctgagatcacaagggtgagccaccacgcctggcccggggctagattttattacagaagcaccaggtcttcagaagcttcaaagaagatattgtacactaaacaattggttaagatagtaaattttatgttctacttttttaccaaaattaaacagctttaaaaattatcttaaaaatatgtgtcttgctgggatctgcccaattcggattggcaaaaagactctgctcattaaaatctttgcattttaatgcaaagcattgaaaaccttgtctctaaaatcacaacctgtgaggcaccttgctgatttagaaagcacatcagagagattgaccctgagctccccttagaacagtgccccaccaggtgtggggatggcccaggggactcagcagagcaggttcaaatgaaagctccccatagctactaactgccagcgcttgctttgggcctgttccccctgggcaaggaccagccatccttccaagccgcgcacaaataccccctcccatgtgtgtccctcatcttcccacatgaaggaacaccctcctgctccctgaggcctggatccacagtgatggagcgtatccggatctccctgtgtgacaaatgctcacacatttctttgcttctctactagaagcatgaggtctttgagactatactagatctgtgtacagcttttgagggaaaaaagccctagtggcctactgttgctcaattggaatgtgatcaattgtgtttcccatgggagcaggaggcaagggaggggtctgtgcgtgcgtggagctcactttgcagtacacccatctgtggccaaccattgatgcctggatccatggctgcacccacacctctgctcagtccctggacggtccctgcggccatcctcaaaaggaaaccccaattgtatccttgtcttaattatcatgagggcatctggaagtggtggcagaagccagagacaggtgagggtcccagtggttcctggcagctgtgaagggcttagcttagggtgaggactggacagagcccctgggtcccattctgcccccagccactcaggcaatatcctcttttccccttctctctcagcctcttctcaccctagggctgtacccaaagctctgaatgagactgtccctgccccgccccatccactcctggtccagctcagcagtgaccttggaactccaggagcagctcagtacccctgtctccgagtcagctctgctccaggcagggccagaatctggagtgtgcaggaggccggatggcaggggcattgccccaggactgagccgtattctgagggttcccagagacctgacctcctacttgtatacagtcttttcagtcagcgtctgccttaaaggctgtgacccaggcaccttccctgggaattaactccagcattgtcctctgggtcgacacagtccttggcagcctctccttcctggggttacacccagttcctctgctcttctccagtggatggaatctccttctccttgacacacagcatctggagccaccaatctgctgccccactcaaatgtgaggaccgcacatgcctgagctcctgctgtctgcacaccacgcaccgtgggggttccttatgaccagagacacagtctgaaacagacctgaatttgctaaaccctctagagctcgacaggacctaagccttgatatggttctgtgtgctcctcccagggcgcccgctgtccccgagctccgggcctgagtgctggctggcggagacccacagtgggtgccccgctcccggacgatgcccctgggcttccagatccagagcctcgggacgaaactgtttcaggaagacccggaaggactcgccggtcgcggcaagggacaggcggttcctgagacaggaggagccaggaaatgcggggcctggtggggtgaggagcacggggttcctccttcatcctcgcggggactttgccaccggctcagtgtggaggcctcaccgtcccgcccggatccgtggggctccgacagtgtggcccctgcgaggaccccccccatcctcctcgccctggggctgctgcgggagggcgcccgggcagcactaggtcctgagtgtccagggtccggcaggggcttcccgttgtcgcctccctgaccccgccgcttgcggtccagggctgctggtttctccgctggtctgggaggccctagcatggacgtcgtgaggcggagaaaaccttgggatgggtggaaaagaaggattggagggagggcggcagaaagggagaggaaggaaacagggccggagaacaatgagaaacccccaccacgaaaatggggagagggggacacgcgcacagcccccacactccaccgactctccgtctcctgctctctgcccagtaaggaacacaggccccaccccctccac

SEQ ID NO: 220 - DNA, 3330 bp, Homo sapiens
cggcggaagcggagagcaacagcgcgccgagacggagttttgccatgttgtccaggctggtgtcgaaatcctgagctcaagtggtctgcctgcctcggcttcccaaagtgctgggattacaggtgaggctgctgtcagaaaggaacttttacacagtttgccttcagagacagtctatcggcatgttgtagagttttattactaagaaaataaatgttacttacatgattgtggtggtgccatgcagcaagaatcagagagatgcagagttagagccagaaggcctgacatggcactttatgtacctaaagctcgtaggggtgcagtactccttaagacaggtgatgaagaagaaagctgtggttcacctaactctgtggtgaaagaaaagcaaaaagaaagttctctctcccaaaaagaagtctttaaagacaaaccggaggctcgaagactaaatatcaatcctgatagaaaggagcataattgtagagaagaaaagaaatcttcaacaaaattaagaatggacacatgccttcaaaaaacaaatagagtttgttctaagagaggaaccactgaatccaaagaagtattatcccaaggacaacagcagggagccccaaatgctggggttataactaatgcacctttgcagagacattttaaaccaaagaaggtggagtgtttggaagttgaaactacggatgtgacaggacatgagaggatacttctttcacaggcctgtttagaaatcagcgaggctcaagttccaagcaaaccattccaaaatgtggaattctgtgacttcagtaggcatgaacctgatggggaagcatttgaagacaaagatttggaaggcagaattgaaactgataccgaggttttggagatactatatgagtttcctagagtttttagttctgtcatgaaacctgagaatatgattgtaccaataaaactaagctctgattctgaaattgtacaacaaagcatgcaaacatcagatggaatattgaatcccagcagcggaggcatcaccactacttctgttcctggaagtccagatggtgtctttgatcaaacttgcgtagattttgaagttgagagtgtaggtggtatagccaatagtacaggtttcatcttagatcaaaaagatacagattccattcctgcaactatgggtcacatctctctgtcagagagcacaaatgacactgttagtccagtaatgattagagaatgtgagaagaatgacagcactgctgatgagttacatgtaaagcacgaacctcctgatacagctgtccttgctcatgaaacacatagagatagtggatttaagaatgtaggtgacattaccaataaagcatgtatgatggacactacaggtatgtcctgtagtgatcatgtaactgttgatagcccttatgtagttgcagttagaatagctgatgagacctctattaatacacgaagtttctcaaagtttgtaggaatgagtgcagatgcaacccctcttcatgtagctagaagtgggaatgacactgaagatttcagcaacccttctgcttgctcagatatttatggtgagagtatttcatctcattttacagagtcaacaggaaagttgatagagagcttgtcagattgtgcttcctccttacctataaaaaagattgctggtagtaattataacacttttttggactctgaactcagtatgttaaatgggacaaaagttctttcagacagtgccgtgggcattgacctgggtagtactggtgatacaacagaagcattgcacgaactaagaactgccgaagagttcaaaacagaagagcaagatgactcagggagtatagaatttggtgtatcttttcctgatagggaatcatcatctatggaaacatccatcgaaccaaaagcaactgaaacttctcgcacagagggaattactgccattgaggagagctgggagtctatgtttaacgatgatggtgactgcctggatccacgtcttctacaagagttatcagggaataccaagagcagagagagcatccaggaacctagatctgattactacaatcatgaagttcctgatattgacctcagtgattgtgaattcccacatgtcattgaaatttatgactttccccaagaatttcgtactgaagaccttctacgggttttctgcagttatcaaaagaaaggatttgatattaaatgggtggatgatacacatgccctaggagtattctccagtccaattacagctcgtgatgcgttgggtattaaacacaccatggtgaagattcgtcccttgtcacaggccacaagagcagccaaggccaaagctagagcttatgctgagttcctccagccagcaaaggagcgtcctgagacttcagcagccctagccagaaggttagtcatcagtgcccttggggttcgaagtaagcagagcaaaaccgaacgagaagcagagctcaagaaactgcaagaagccagagagagaaagcggttggaagccaagcaacgggaagacatctgggaaggcagagaccagtctacagtttgaacatcactcaatgaaagggataattccatgaatcagaaaatgtttccatagccttcagataagatgatccttccagagctctatgtacatgcagatgtgcatgttaaagagataaagtgatcgagacaaggactgactgggtatagaaggaagacagactcctgtcttcactcctaaatgcagttctttggaatcaccctactgtggtgggcgtagtagggagccatcagctaggaagaaacgtgggagatgtgaattccaagagttgcctggacagggcaagtcatgttagcgtgggtcacacttccaagatatttaaagcaaatacaaaacagaacagaggattcaaaccgcaagtatgggagatttaggccctgcagaggcagaccattccttagtatctcacaaagcagagtaatactggaggcagagtagggggtggttggagagcagttagtacaaagaggcagaacagtgtctggtttacttggcatacacagaatctgcactgccggttccagaactccaaagttggtgaactacaggagatgtgggtatttagactccaaagtttatactgagctcagtgcctgggaccgctccagctgcactgcagccaggggggataccagcttcattcctcagagtaaaccaaccttgggagctgtgtgccagttccagtgtaagcagtaataccatgttgtaagagggaacattaaagcccattttatgacataaaaaaaaaaaaaaaa

SEQ ID NO: 221 - DNA, 552 bp, Homo sapiens
ttttttttttttttttttcctgttgcttgatttatttgaacggcagcaatccggaaaagtcgtcagtgcacaatgactcattccctgagggttctgaataagattctaaaatcaccacccatggttttcctgcactttgaagtgacagaacaaatgacagcagagatgggcactgtctcctgagtccagaatggatgacacacacgcgtctcacaacaataacatcctcatctaaaaacagcctgaaaggaggttatttctgggctttgcttgttagtaagcatttgtgcacctgtgggcagagacctaagaccaagatggtttgggttttttttctgtatagtcaatcaacaaacttattgatgccttttccatgccagggcctgttctaaggacatgagattaattcaaccctcagaggaaaaccctcacagagcaaaaattgggataacaaatgagaaaagccataaatgagagacagatgaggaggctaagggagaaagactctggggaagtgtcccaagaggtgaccacggagatgatgggtgagag

SEQ ID NO: 222 - DNA, 1425 bp, Homo sapiens
atgagcatcagggccccacccagactcctggagctggcaaggcagaggctgctgagggaccaggccttggccatctccaccatggaggagctgcccagggagctcttccccacactgttcatggaggccttcagcaggagacgctgtgaaaccctgaaaacaatggtgcaggcctggcctttcacccgcctccctctagggtccctgatgaagtcgcctcatctggagtcattaaaatctgtgctggaaggggttgatgtgctgttgacccaagaggttcgccccaggcagtcaaaacttcaagtgctggacttgaggaatgtggatgagaacttctgcgacatattttctggagctactgcatccttcccggaggctctgagtcagaagcaaacagcagataactgtccagggacaggcaggcagcagccattcatggtgttcatagacctttgtctcaagaacaggacactagatgaatgcctcacccacctcttagagtggggcaagcagagaaaaggcttactgcatgtgtgttgcaaggagctgcaggtttttggaatgcccatccacagtatcatagaggtcctgaacatggtggagcttgactgtatccaggaggtggaagtgtgctgcccctgggagctgtccactcttgtgaagtttgccccttacctgggccagatgaggaatctccgcaaacttgttctcttcaacatccgtgcatctgcctgcattcccccagacaacaaggggcagttcattgcccgattcacctctcagttcctcaagctggactatttccagaatctgtctatgcactccgtctctttcctcgaaggccacctggaccagctgctcaggtgtctccaggcctccttggagatggtcgttatgaccgactgcctgctgtcagagtcggacttgaagcatctctcttggtgcccgagcatccgtcaattaaaggagctggacctgaggggtgtcacgctgacccatttcagccctgagcccctcacaggtctgctggagcaagttgtggccaccctgcagaccctggacttagaggactgtgggatcatggattcccaactcagcgccatcctgcctgtcctgagccgctgctcccagctcagcaccttcagcttctgtgggaacctcatctccatggctgcccttgagaacctgctgcgccacaccgtcgggctgagcaagctaagcctggagctgtatcctgcccctctggagagttatgacacccagggtgctctctgctgggggagatttgctgaacttggggctgagctgatgaagacaccgagggacttaaggcagcccaagatcattgtgttctgcaccgtcccctgccctcgctgtggcatcagggcctcctatgacctggagcccagtcactgcctctgttga

SEQ ID NO: 223 - DNA, 212 bp, Homo sapiens
ttttttttttccatcaatttgttcaacaaatatttattgagcagttattatatgttaggcatatgctgggtgtattatctttgaaaggcaatgcaaagtaaatagccagagagtgagaggtgttatttcagttagggtagtcagggaagcctcttcaatgtgaaatgagctgagaaaagacctgaataaaatgagagagagcaggagaaaga

SEQ ID NO: 224 - DNA, 404 bp, Homo sapiens
atagcggggtcaataaatatttaataagtgaaaataaacatgacacacattcctggcaagccagcagcacttcggactagtactatgattattaatataagaatccatttaaggacctatatatgttcttagtctaaagcagctacagtgctgattgtttttagaagacaactgaggaaaacaaagaggcaccaaaacttaagcaaaagaaagagttcaaaaacagtcactcctctttatcttaacaaccaccaaactttcctcctcttgcatgcctccgcagacctttgggaagatacagaacaggatgtaaagggaggggaagtgaacacaggtactgccaagcctcagggattagactgctccctccctcgctttgacgcgctctccagcttcagctattg

SEQ ID NO: 225 - DNA, 2879 bp, Homo sapiens
acgcggaagtcaggtaggagcacccgccgctggcagccactctcctggccgccaaaccccagctggaactccggccacagccagcatgcagggcgaagagagcctccggatcctggtggagcccgaaggggacagcttcccgctgatggagatcagcacctgtgagaccgaggcctccgagcagtgggactatgtcctcgtggcccaacgtcacacccagagagacccccggcaggcgcggcagcaacagttcctggaggagctcaggagaaagggcttccacattaaggtgatccgggaccagaaacaggtcttctttgggatccgtgctgacaacagtgtctttggcctgtaccgcactctcctcctggagcctgaggggcctgccccccacgccgagctggccgcgccgaccaccatcccggtcaccacgagtctcagaatccgaatcgtgaacttcgttgtcatgaacaacaagacctcggctggtgagaccttcgaggatctgatgaaggacggggtctttgaggccaggttccccctgcacaagggggagggacgcctgaagaagacgtgggcgcggtggagacacatgttccgggagcagccagttgatgaaatcaggaactactttggggaaaaggtggccctgtacttcgtctggctgggctggtacacctacatgctggtgccggccgccctgacgggcctcttagtctttctgagcggattctcgctgtttgaggccagccagatcagcaaggagatctgtgaggcccacgacatcctcatgtgtcccctcggcgaccacagccgcaggtaccagcggctctcggaaacctgcacttttgccaagctcacccacctctttgacaatgatggcacggtggtgttcgccatcttcatggctctctgggccacggtgttcctggagatctggaagcggcagcgcgcccgcgtggtcctgcactgggacctgtacgtgtgggacgaggaacaggaggaaatggcacttcagctcattaactgccccgactacaagctccggccataccagcactcctacctacgcagcaccgtcatcctcgtcctgaccctgctcatgatctgcctcatgatcggcatggcccacgtcctggtggtctaccgcgtcctggcctccgcgctcttcagcagctcggccgtgcccttcctggaggagcaggtgaccacggccgtggtggtgaccggggctctggtgcactatgtgaccatcatcatcatgaccaagatcaacaggtgcgtggccctgaagctttgtgacttcgagatgcccaggaccttctcggagcgagagagcaggttcaccatccgcttcttcacactgcagttcttcacccatttctcgtctctcatctacatcgccttcatcctgggcaggatcaacggccaccccgggaagtccacgcgcctggcgggcttgtggaagctggaagagtgccacgccagcggctgcatgatggacctcttcgtgcagatggccatcatcatgggcctgaagcagacgctcagcaactgcgtcgagtacctggtcccgtgggtgacccacaagtgccgctctctgcgggcctccgagtccgggcacctgccccgggaccccgagctcagggactggcggcgcaactaccttctgaacccggtcaacaccttcagcctgttcgacgagttcatggagatgatgatccagtacggcttcaccaccatcttcgtggccgccttcccgctggcgccgctgctcgcgctcttcagcaacctcgtggagatccgcctggacgccatcaagatggtctggttgcagcggcgcctggtgccgcgcaaggccaaggacatcgggacctggctgcaggtgctggagaccatcggtgtgctggcggtcattgccaatgggatggtcattgccttcacatctgagttcatcccccgagtggtctacaagtaccgctatagcccatgcctgaaagaaggcaactctactgtcgactgcctcaagggctacgtcaaccacagcctgtccgtcttccacaccaaggacttccaggaccctgatgggattgagggctcagaaaacgtgactctgtgcagatacagggactaccgcaatccccccgattacaacttctccgagcagttctggttcctcctggccatccgcctggccttcgtcatcctctttgagcacgtggccttgtgcatcaagctcatcgccgcctggttcgtgcccgacatccctcagtcggtgaagaacaaggttctggaggtgaagtaccagaggctgcgtgagaagatgtggcatggaaggcagaggctgggtggggtgggggcaggctctcggcccccaatgcctgcccatcccaccccagcatccatcttcagtgccaggagcacagacgtgtagggccagagcccgtccagaggccaccaggagctgagacagtgccaccaccagcacctcccacaagcccaccgctgtgcgtgttgaggggtgctgtgagaaggctgtgcccatgtggggccgcaggaatcccctgtatgttcagggctgtgagctgccaccctattccgcctgctccgtctttgtgggggctctcaggcttggcacagccctgacttgaactctgggtgaccctgggcacccacagaactgggagtgagggctcctcaggcagccacaaggcaggaaaactggcgcaaatttcctgggcctccctctgacttctgggcgccagatcctgccgtgcccccatcctggctgttgggggtgtcctgagcccacctcgctggcctgttcccttcagccaacccgtttctgcagtaaaattaagcctgtctgtcttgcaaaa

SEQ ID NO: 226 - DNA, 659 bp, Homo sapiens
agcgggattcatcccaggccaggcgagtggaaaagtaccagccgcgcgcgaggggcgggggcgcgccgaggggcggaaaagtacagacggcggagccgcggggagaacaaagatgatgccaccgctgtgttgcggccgtcgaggccccctactccggcagatttcaacctgctttcactcttcaaaactagccggaggtcggcgagcagctccttttcgggatgtgctttttgtacggccatggaaactggactagcggaaaggctaccttttggccagcaagccaggccccttagaaagaggccccagtggggagcccggcgctcctaaggccgtttgggagtccccagttttccactcgctgacacgttgcttctcttatcccaccaccgccgccccgggcaaaggcactgccttgtctgaatgcgggtctgaggcgctttctgcggagcctggtcctttcccttcaatggtgatgtgtgtggtcttgctgagccaggcaactagggggacccttcgctgtggaaaaatcggtgctgcgggaaaggcaagactcactcccttgcaggaaacaaagaccccttaggagagagaaatgtccatggaatgaactgaataaccaagtttgacctagaaaaaaaaaaaaactctccagcgct

SEQ ID NO: 227 - DNA, 240 bp, Homo sapiens
atgacatgctatagatggtatgataaaaatgtggccatgtacagatgggtcaaagagaaaaaagtggtcaaggagtttggatcggagcctcaggcaggtcccgcaggagatattccagaagaagtcttcatcatcacaagagatgacagttacatgtatgttattgcccctgaagatcctccagtggatcaagatgtgaaggtggaagacagtgatattgatgatcctgaccctgtgtag

SEQ ID NO: 228 - DNA, 2100 bp, Homo sapiens
tctgcctgctgtcgggggcgggctggccaggccgaggccggagcaggcaggcatcccccggagttgtctcttttcatgccagcgtcaacaggaggctgtctggacacactgattactcactcaccagcctccctcttttgtccaccagcccagcctgactcctggagattgtgaatagctccatccagcctgagaaacaagccgggtggctgagccaggctgtgcacggagtgcctgacgggcccaacagacccatgctgcatccagagacctcccctggccgggggcatctcctggctgtgctcctggccctccttggcaccgcctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccaactggctcaagccagggcagccctctgtggaatcccaaccccgagcctggcgtccggcctgtggcgcaccctgcaagtgggctggaacatgcagctgctgcccgcgggcttggcgtcctttgttgaagtggtcagcctatggtttgcagaggggcagcggtacagccacgcggcaggagagtgtgctcgcaacgccacctgcacccactacacgcagctcgtgtgggccacctcaagccagctgggctgtgggcggcacctgtgctctgcaggccaggcagcgatagaagcctttgtctgtgcctactcccccagaggcaactgggaggtcaacgggaagacaatcgtcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacgggggagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgggctcacctacaagaccgccaaggactccttccgctgggccacaggggagcaccaggccttcaccagttttgcctttgggcagcctgacaaccacgggtttggcaactgcgtggagctgcaggcttcagctgccttcaactggaacaaccagcgctgcaaaacccgaaaccgttacatctgccagtttgcccaggagcacatctcccggtggggcccagggtcctgaggcctgaccacatggctccctcgcctgccctgggagcaccggctctgcttacctgtccgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcaaaggagaggacaccgccagtggtccaaaaaggctgctctcttccacctggcccagaccctgtggggcagcggagcttccctgtggcatgaaccccacagggtattaaattatgaatcagctgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 229 - DNA, 2134 bp, Homo sapiens
ctttgaaaataattcggattttaacttctactgttctctccttcctttcattgcccactctcaagtactaattaaattttgtcttttctaccttataaaataaatatctcatccatcttttcaatagccacatcttcttcacaactcaccggaactgttgcagcagttgcctcctgcccatcccctcctccagcttccctgccaatcagtttgtaatcgacagtggtgatacccctcatcatggtgttgttctccagttgatattctcatctgggacccatcactggagccacagcatttttagaattaaaggctgaactttttagcatgacagtcacgaccatcataactgtcactcatttgtcattcagtcttatctctcacatctatgatttttacattccagatatcttacagtggccccagtatacctaccttcccctttatgctgtggctcacacaggtgtctctagctaaaaaaaaacaccttcctcttgttaacatagataactcctatgggtccttttcactctatcaatatcacctcctccagaatgtctgttgaaaccatgagactcagggaaacactttttctgctcccataaagttccatgattactccagatagaaatagtttactattgcattggaatgtctttttcctccaaagtgtatccctgggtcctaacatagtatttggacatgtggtaggaactcaagtagtatttgttcaataaagtttttcagtcaactattgtatcaatgccttaattctaagacatatcattgatctaaacatttcttcaataaaaaatagacttctgttcatgattgaaaaacttcacaactttataaacattaatatataaaagtataatttagaattgagaaatatggcaaccacttttcttaaggagacattctattttttttccaaccatgaaaactgggaaatgtccttaaataccattcttaaaagctgtgtttttgcatttaacagtctccataatttgaagtgaaatgtcattcatttggatgtcaaatggcaaaactatatcttttttaaaatttaagcgtatattatataaaataataacttcgtgaaaggtaattttacagaattaaaaccctgagtactcatcaaaaccatatcagtcattttatggatgagcaagcttgatctggaagggaggtgacattagtttctcaggcccacagagcttgttagtggtagaattagaaccagaacacaagattacctggcttattaccaaggaagcttgaataattaaaaacgtattttttaatactaggtgtttgggtgctgtcttcagcattgagttataatgatgatcaaattgggaaggcacccagccctgtggaagttcgtgcagtggagaagaggagataatggcatagcagtggagacacccaaagtcatccacagtttggctttaaatagcatttctaatatcattttctccctccctccatgatgaggtctaaatttcaaccatttgaactccttgctattcctggttcatttccatgcttattgcctctgagcctttgctcctgcttgccctgctggttcatgtctgctggttcatgtgtccttccctttggaagcacatccaaatcctacctgatgtctaagacctatctgaaaaggcagctcctctacagagactttcctagttctctctgtcagtagtaacttcttcctcccttgagtcccatacaacttttctttcccttgtttgtagcacttctctagttaagctttgtgttacagttattttctatctatccaaatttccttcatgatttttagtaaatcctgctgtgagttatttgctgcataatttaatgaaattactgtagagtcagcaaagaagtagagaagaaaaaacaccaagaatgaggagaacctagcaagggcaggcttttggaagcaagaggtagataatttaataaaaggatagttaatagtttcaaatgtgttatgactttttgctctgagtctctactttttgtagtttgtgttattctgatgtattatttaacctttgttccttatcacttttatttaaatataactttcaatttgttttcaaaaaaaaaaaaaaaaaaa

SEQ ID NO: 230 - DNA, 1141 bp, Homo sapiens
  misc_feature (626)..(626): n is a, c, g, or t
  misc_feature (849)..(849): n is a, c, g, or t
  misc_feature (969)..(969): n is a, c, g, or t
  misc_feature (1033)..(1033): n is a, c, g, or t
  misc_feature (1067)..(1067): n is a, c, g, or t
  misc_feature (1077)..(1077): n is a, c, g, or t
  misc_feature (1080)..(1080): n is a, c, g, or t
ggtccggattcctccgaattcctcagggttctcttacagccctgaaaacacctcttcaaggaaataaataacatctgcaaatggtgcagctgcccctaagtattcaaggcaaagaagccttagtttgcagagatgatgataaacttttcatccttccacagaaaatgagaaagccacaggaaatacacggttattttctaattaaagttcaatgtgtacgcttttaaattctgaagttatccttcttttatgatatcaaaatagccctcttttttgaaatgatggtagatcataccttttggtctttttcattgtccttacataaaagttggtaatcatatgtcagtcccagaagttttatttgacacttactggtctataaaatccaaaggaatggggatcactgcctgccttaaaggtttttttgtttgtttgtttgtttgcatgtgaaggatttttatgtcacaaatccagctaacagtggatctaggatctaggcctcaccgaggatgtcactgaacctgtcagccccaatgacaggcacacaccttcaaagagcaagagtgcccatcactttctaggctccttgcctgctgctcattccatcctcacggatacagacttgnttctgggttcatcttccaccagagattgcaaaggatcctctgcccagtgcttctaggaggccttactgggatggttcataagccactttcctcttggggacagcccctgtacactggggcatggtacggctggctccacttggtatttgttgcaggagggaagaacatctccctttttgcttggctaaaagggccaccccaggagagctattttgcctcaggnttcttggaagggttttctctaagaaaaacagggcatctgatagttactctctgccccctagggaggaaagaaagattcgccccttccttcccaagtcccaaggctgtggtggttcccagncccccaagggtagcaagtcaaaacccctccggaagaggctttttagcatggcacttgttcaagngtcctctcaagaaaaatggaattcaggggggtcnaagggctcanccnagggcaccccccttttttgttttttcaagttccacagggaaattttgagatgggcaccggc

SEQ ID NO: 231 - DNA, 2559 bp, Homo sapiens
agcagcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaagaggaactctatcccaagaacccttatctccaagactttctgagtgcagaggtgagggcctctgtcctgaactttttaacccggtgccacaacctgagggtctccataggggcagggagtgctgagtagtgatggtgtctggagggtcaaatccattcccaatggcaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacttggggcctgctacctggtccctaccatcgtggggccattctgcccttccactgcagtgccatcctggctacagccctggacacagtcactgttccttatcgcctgtgttcctctccagtttccatggttcatctggctgacatgctgagcttctgtgggaaaaagtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgagggtatagacagagcatgccacacaagccagctcaccccagggacacctccaccctctgcccttcatgcatgtaccactggggaagaaatcttggctcagtatttacaacagcagcagcctggagtcatgagttcttcccatctgctgctgactccctgcagggtagctcctccttacccccacctcttctcaagctgcagtccaccgggtatggttctggatggttcccccaagggagcagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctatttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactaccccctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaacggtgggaaacctaagaaaggaggagggctgtattcactggtcttttttttttgtttttgagacggagtctctctctgttgctgagactggagtgcagtggcactgtgtcagcttactgcaacctccgtctcctgggttcaagcaattctcctgcctcagctactttgggagaggctgaggcaggacaatcacttgaacctgggaggtggaggttgtagtgagctgagattgtgccactgcactccagcctaggcgacaagtgaaactgcgtctaaaatacataaataaataaaaatttaaaaatcaaaaaaaaaaaaaaaaaacaaaaaaaaaaaaaaaa

SEQ ID NO: 232 - DNA, 1538 bp, Homo sapiens
atggctctgaaggagcgcattggctggagatacagcctcctcttcgtgggcctactacagttaaacattgtcgtcttcggagcactgctcagacccatcatcatcagaggaccagcgtcaccaaaaatagtcatccaggaaaatcggaaagaagcacagtatatgcttgaaaatgagaaaacacgaacctcaatagactccattgactcaggagtagaactaactacctcacctaaaaatgtgcctactcacactaacccagaactggagccgaaggcagacctgcagcaggtcctggtgaagaccagccccaggccaagcaaaaagaaagccccgctattagacttctccattttgaaagagaaaagttttatttgttatgcattatttggtctccttgcgacactgtgattctttgcaccttccttgtacatcattcctctgggcattagtctgggcattgaccaggacagcgctgcttttttattatctacaatggccattgcagaagttttcaggaggatcggagctggttttgtcctcaacagagagcccattcgtgtgatttacattgagctcatctgcgtcatcttattgactgtgtctctgtttgcctttacttttgctagggaattctggggtctaatgtcatgtagcgtattttttgggtttatggttggaacaacaggagggacccacattccactgcttgctgaggatgatgttgtgggcattgagaagatgtcttctgcagctggggtctacatcttcattcagagcatagcaggactggctggaccaccccttgcgggtttgttggtggaccaaagtaagatctacagcagggccttctactcctgcgcagctggcatggccctggctgctgtgtgcctcgccctggtgagaccgtgtaagatgggactgtgccagcatcatcactcaggtgaaacaaaggtagtgagccatcgtgggaagactttacaggacatacctgaagactttctggaaatggatcttgcaaaaaatgagcacagagttcacgtgcaaatggagccggtatgacacactttcttacaacaacaggcactgtgttggctggagagggatggggtgggcccaacggagacacaaggaggtagaggagctaacccctctactccactttcaaaactacattttaaagggaatgtgtatgtgaagagcactaccaacatcgcttttgttttaagttttcctttttgcttgtttttaaagccaaaacaaaaaacaaccaagcactcttccatatataaatctggctgtattcagtagcaatacaaaagatatgtagaaagactctttggttcacattccaatattaaaatagtgacacgaactggcaaagtggttttaaaagctttcacatgggataaatgattttctttctttcttttctttcttcgtatggtcttgtcagaataaactactatcttgaataaaacaacatccaacccaggtcattgaaatgaaattggccagtcaaaaaaaaaaaaaaagac

SEQ ID NO: 233 - DNA, 2488 bp, Homo sapiens
ttttgtccgcctgccgccgccgtcccagatattaatcacggagttccagggagaaggaacttgtgaaatgggggagccggctggggttgccggcaccatggagtcaccttttagcccgggactctttcacaggctggatgaagattgggattctgctctctttgctgaactcggttatttcacagacactgatgagctgcaattggaagcagcaaatgagacgtatgaaaacaattttgataatcttgattttgatttggatttgatgccttgggagtcagacatttgggacatcaacaaccaaatctgtacagttaaagatattaaggcagaacctcagccactttctccagcctcctcaagttattcagtctcgtctcctcggtcagtggactcttattcttcaactcagcatgttcctgaggagttggatttgtcttctagttctcagatgtctcccctttccttatatggtgaaaactctaatagtctctcttcagcggagccactgaaggaagataagcctgtcactggtcctaggaacaagactgaaaatggactgactccaaagaaaaaaattcaggtgaattcaaaaccttcaattcagcccaagcctttattgcttccagcagcacccaagactcaaacaaactccagtgttccagcaaaaaccatcattattcagacagtaccaacgcttatgccattggcaaagcagcaaccaattatcagtttacaacctgcacccactaaaggccagacggttttgctgtctcagcctactgtggtacaacttcaagcacctggagttctgccctctgctcagccagtccttgctgttgctgggggagtcacacagctccctaatcacgtggtgaatgtggtaccagccccttcagcgaatagcccagtgaatggaaaactttccgtgactaaacctgtcctacaaagtaccatgagaaatgtcggttcagatattgctgtgctaaggagacagcaacgtatgataaaaaatcgagaatccgcttgtcagtctcgcaagaagaagaaagaatatatgctagggttagaggcgagattaaaggctgccctctcagaaaacgagcaactgaagaaagaaaatggaacactgaagcggcagctggatgaagttgtgtcagagaaccagaggcttaaagtccctagtccaaagcgaagagttgtctgtgtgatgatagtattggcatttataatactgaactatggacctatgagcatgttggaacaggattccaggagaatgaaccctagtgtgagccctgcaaatcaaaggaggcaccttctaggattttctgctaaagaggcacaggacacatcagatggtattatccagaaaaacagctacagatatgatcattctgtttcaaatgacaaagccctgatggtgctaactgaagaaccattgctttacattcctccacctccttgtcagcccctaattaacacaacagagtctctcaggttaaatcatgaacttcgaggatgggttcatagacatgaagtagaaaggaccaagtcaagaagaatgacaaataatcaacagaaaacccgtattcttcagggtgctctggaacagggctcaaattctcagctgatggctgttcaatacacagaaaccactagtagtatcagcaggaactcagggagtgagctacaagtgtattatgcttcacccagaagttatcaagacttttttgaagccatccgcagaaggggagacacattttatgttgtgtcatttcgaagggatcacctgctgttaccagctaccacccataacaagaccacaagaccaaaaatgtcaattgtgttaccagcaataaacataaatgagaatgtgatcaatgggcaggactacgaagtgatgatgcagattgactgtcaggtgatggacaccaggatcctccatatcaaaagttcgtcagttcctccttacctccgagatcagcagaggaatcaaaccaacaccttctttggctcccctcccgcagccacagaggcaacccacgttgtcagcaccatccctgagtcattacaatagcaccctgcagctatgctggaaaactgagcgtgggaccctgccagactgaagagcaggtgagcaaaatgctgctttctgccttggtggcaggcagagaactgtctcgtactagaattcaaggaggaaagaagaagaaataaaagaagctgctccatttttcatcatctacccatctatttggaaagcactggaattcagatgcaagagaacaatgtttcttcagtggcaaatgtagccctgcatcctccagtgttacctggtgtagatttttttttctgtacctttctaaacctctcttccctctgtgatggttttgtgtttaaacagtcatcttcttttaaataatatccacctctcctttttgccatttcacttattgattcataaagtgaattttatttaaagcta

SEQ ID NO: 234 - DNA, 2118 bp, Homo sapiens
agaggtttaatgaacttacagttccacatggctggggagggcttacaatcatggcagaaggtgaaagcatgtctcacatggtggcagacaagagaagagagcttgtgcagggaaactctcctttataaagccatcagatctcatgagacttattcgctattacgagaacagcacgggaaagacctgcccccatgattcagttacctcccaccaggtccctctcacaacacctgggaattcaaggtgagatttgggtagggacacagccaaaccatatcactgccccagaactcaacttttcctggaactgttcttcctatgagggagagttctccatagtgcccacttcccaattatcatcagggcatgatgtatctaattggcatggcctaggtcaggcactgtgcactagctgcaacggagtcttggaaaggatacatttgcattttcagcttctacattggcaggtagggatttccccagacataagaaaagggttaaatgctgggcagtcaaaaaagaatgatacatgtcctttcttactggaacatgatggctgtgaagaagataggcggtagatgaagctggagagttttgactttatcctgtaggcagtgtggaaagatgagccactgatgatttttgaggaagagagtgataggtgaatagatgaaatatggagacatgggaggtgagaagttgagagaagctaagtggcattgaggactaaaatacagcgagaatggaaaagaaggccagatgggaagaacctagaggtcacaggaccaagcatatagtgcctggctgtggggaagcagagacaagtttcaggcctgggcaactggggaataatatagtatatttgtttaaagcatagtctctgaaatcagactgactggtttgaaacccacctctaccacttattagctttgtgacaaattactcactctctctgtttggggttccccatctgtaaaatggggataactactttcttcattggactctgtgaggattgaaaaagttgatgtatgtgaaacatttattaaagtgcctggacccatggtagctgctcactaaaaggggtgtgtgtgaatgaatggtaggatgatgaacaaatctgggacatattgcatggtggtgggtttggtacatttgggattttaggtggaacatccttgtggagctgtgcactagaagtgtttatctacagcttgtgagaggccagggctggagacagaggtggggaaaccacaagagtaggttagatcagggaggaagactgtagttggagacatgagtgccaaggacggaaccttgggaccatttctgtagcagaaagaggaagtcgatttggcaaaggaagctgaattgaacacgctatgaggtaggagaactgagagagtgctgagtcatagatgtctaagaaacacaaagttttaagaagcacagaagtagttactggcattagatgctatggaaaaattagacaatggtaagtgagaagttgcccttggatttaacaattaggtgctcgctggtgatcaaggagaaggcagtttcgctgtagtggtgggaacagtttcttagtgcttaataacaatgatgtaatcgtgtatgtatgttaaaaaggaaatgaaaaataaaacatgctatgaaatttttgtccaaggaaattgtctagcttaatacagaggtgtatagaagggaatgtctgtagaaaagaatatcccagtggtggttttaaaacctagctgctgcttgaaagaattgtgcaaataaaatttacagtattttaggctaagtgtgctggctcaagcctataatcccagcactttgggaggctgaggcgggcagatcgcttgagctcatgagttcaagactagcctgggcaacatggtgaaaccctgtgtctacaaaaaaatacaaaaattagctgggcatggtggtgtgcacctgttgtcccagccacttgggaggcttaggtgggaggatggcttgagtctgaaagggtggtttgagcctgggaggtggagcttgcagtgagcagagagtggcatcatgccactgcattgtagcctgggagatagagccagaccttgtctcaaaaaaaaaaaa

SEQ ID NO: 235 - DNA, 1311 bp, Homo sapiens
gaccagtctttggttatacatttggcaattacttgggagttgttttgaggccacctactaagaatacttgggatagagattacaaattaaacccataagccaggtagacgaggagcaaggaaatgtctgggaattcgtatttcatcggcatatatttaaaacatcttatgcttctaatttccggtgtgagtcaacctctgcggactgaacatcactaaaactctaaggaaacgtctctttttaatcctctgaaaaatcaatacatttaaaaactgcccgttgtgtcgacgctcggaaagagggtagaaaacagcgagtctaagggaaagaggtgcccctgcctccccaggcagccagggcccaggcccggtaacggagtcgtcctctttatgcccaaagccgccggacgggatgcaggtcgaggaccggccgcgcggcgcggagcggggatgcaggtaacagggcccgcgcgaccattccaccggctacggccacccgacacacaccccagaggcagtgtccacgcagccggggtcctggatggcttggcctcgggtcgtccggggcttctcggtgcgcccgcccccgcccccgctctgactcagcatcccagcctcccacagggggcgggagcgctccccgccgggcggcgcaggcctgaccgaccgcgccccgcgccgccttggcccctcagcccgcggccgtctcacttacccagccgggtctccgccgcgccaccgccggcgggctcccgcggcctcctcgagactcaggacacttccggcttcgcaagccctggccggaggccacgtgaccgacggccggcgcgccggtgcgggtgcgcgtgcgcacgcctatggcccgtctggtagtcaccacagccgcggcggcaactgccgagtcggcttccgcggccacggtaatgagggggatgtctggagacaccccgtccactgttgccctcgccctttactctaaaggggaatgaggagccctgagcagcgaacacagtaattgggattcccgcaactgcaaatcccgccccttccccgagcgctggccgacagtagggcggaccgacgctgagcaagggattacatcccaagatttacaggtgtgcagaacgtgggacacgtggggggcaggcacagacggccggcagagctgggagggatggattctatgttttaagggcccactttggctgcagtggagccagattatcgtctcgcagtaattcagactttacattgtttttttcattttcccatcacccagaaatacattaaattcttaatgtaaaaatgttca

SEQ ID NO: 236 - DNA, 1295 bp, Homo sapiens
atgcgggtggggcgtccccagggcccgtgcgctgagctagccgagccgccgcgggtgggcgccctctccccggccgtgccgcgcgggcgccaggactcggggagatctgagaggattctgcaggaaccccccggttcctgcgccgggcggtgctctgtcccgcacaccgcgctctcgggacacttctctaactttggggacacgtgggcactgcctctggcagggccttcaggctccacgacccggaccactcaagcccccacggcgtcacctgctgggcgctgcgcgctctacgtcgttttcctccgagcatttccaagcactctcccccttctgctgccaaaagaggatttccaggctcctgaagcgaacgcggtgaccaagaacagggcccttcccccgtgggcgccggcagctccaggcccagcccagggcgtccaacgcggagggggtgcaggagttctcctgggcctgacagcctcagccgtgcagaaacccggcctagggagggcatgcaaagaaggacgccagagaaaaagcccgctccggacactgcgctccaaccaggaggagcaggaggaggaggaggatgaacaaaatggccgccgccaccagccaggcaggaaacagggcagagcgcaggcgcgacccgccaggtcaccgctcaggccagccgcgacagcctgcaagggggacgaccgaggggagagaaaaaagggccgccgaggaaaccctgggacccgctcacgacggatcacgtcgtcgctgtgggcctctggccggccgaagcccagccagctccgggagagatcgggcaaaaagagaaacgtcgtgaagccgaagtctctgggaattgtggtcctggaaatgagagagggaagcacttctgcagaggacttctggaacctgtggttaagaggagccgccggcgcccacccgcgctgggacgtgaagaggagacttctgggtagtgtagtcatacgtgaggacgtgcgacgaccaggaagtcggcgggctgggaggtaaagggaagaataaaagcgacattgaaaggcggggagaccaagtggggaaaagcgctgtctgggaaagcgaactacaagtcccagagttcctcgcgccgggggctgtcctcggactgctccaggcattgtaaggctcttctgttggcccagtctgagctgctgctccgccttcgtccagcccgagagcggtttcttcaactgtggctcaggcagcactctccctccgcgtggtgtccgagccagcagggccgtccggccctcctgtgttca

SEQ ID NO: 237 - DNA, 1675 bp, Homo sapiens
ccagccgtccattccggtggaggcagaggcagtcctggggctctggggctcgggctttgtcaccgggacccgcaggagccagaaccactcggcgccgcctggtgcatgggaggggagccgggccaggagtaagtaactcatacgggcgccggggacccgggtcgggctgggggcttccaactcagagggagtgtgatttgcctgatcctcttcggcgttgtcctgctctgccgcatccagccctgtaccgccatcccacttcccgccgttcccatctgtgttccgggtgggatcggtctggaggcggccgaggacttcccaggcaggagctcggggcggaggccgggtccgcggcagaccagggcagcgaggcgctggccggcagggggcgctgcggtgccagcctgaggctgggctgctccgcgaggatacagcggcccctgccctgtcctgtcctgccctgccctgtcctgtcctgccctgccctgccctgtcctgtcctgccctgccctgccctgtgtcctcagacaatatgttagccgtgcactttgacaagccgggaggaccggaaaacctctacgtgaaggaggtggccaagccgagcccgggggagggtgaagtcctcctgaaggtggcggccagcgccctgaaccgggcggacttaatgcagagacaaggccagtatgacccacctccaggagccagcaacattttgggacttgaggcatctggacatgtggcagagctggggcctggctgccagggacactggaagatcggggacacagccatggctctgctccccggtgggggccaggctcagtacgtcactgtccccgaagggctcctcatgcctatcccagagggattgaccctgacccaggctgcagccatcccagaggcctggctcaccgccttccagctgttacatcttgtgggaaatgttcaggctggagactatgtgctaatccatgcaggactgagtggtgtgggcacagctgctatccaactcacccggatggctggagctattcctctggtcacagctggctcccagaagaagcttcaaatggcagaaaagcttggagcagctgctggattcaattacaaaaaagaggatttctctgaagcaacgctgaaattcaccaaaggtgctggagttaatcttattctagactgcataggcggatcctactgggagaagaacgtcaactgcctggctcttgatggtcgatgggttctctatggtctgatgggaggaggtgacatcaatgggcccctgttttcaaagctactttttaagcgaggaagtctgatcaccagtttgctgaggtctagggacaataagtacaagcaaatgctggtgaatgctttcacggagcaaattctgcctcacttctccacggagggcccccaacgtctgctgccggttctggacagaatctacccagtgaccgaaatccaggaggcccataagtacatggaggccaacaagaacataggcaagatcgtcctggaactgccccagtgaaggaggatggggcaggacaggacgcggccaccccaggcctttccagagcaaacctggagaagattcacaatagacaggccaagaaacccggtgcttcctccagagccgtttaaagctgatatgaggaaataaagagtgaactgg

SEQ ID NO: 238 - DNA, 1267 bp, Homo sapiens
tagtagagacaggacttcaccatgttgcctaggatggtctcaaactcctggcctcaagtgatccttccacctcagcctcccgaagtgttgggatgacaagcatgaaccaccgcccccagctgtcagtctttttcatttataaaattagtattagaataataagacccacttcacagggtagttgtgaggactcctggctaatacagtaaagcgggagtaacagctcctggcatcggtaaatgttctgtcattgttagtggtcactgtcattgctgttgttggttgtggtagcacagggcccagcacagagtgtacactcggtcagtattggctgttgttttactctctcatcacttggtccagttggcctgtaggatgttattacatatgcacacccccaacatggcatctaggacagtaagtgccacccgttagtcttatatgtaagcatggcagagagaagccgagttcttgcacagaatcttgaaggctgattgaagagccagcctcctgacctctgagggcagggactggatctctctctttcccctgtattcccatcctgccacacaaagcctggcccagagtcagccctcacagccttgtttcatgagccagtaggaagcaagaaggattcctggcacaggacggggcagaagtaaaggcctaggactaggatgtagccagaactctggggaaggctttgcagggagctagggggtgatgagacccttcacgggcaggtcccagccaggttgaggagggtccttgtcaggtgaggaggtttggttctttcctggaggcagcaggacatatgtggccatgtgggaccaggagaggaacccacagtgctctgctttcagcagagatctgtgaagctagaatgtcaagggccagggaagtggaaggcccagaaccttcaggggttctggttgccccagagcaagaagaagaagtggagggagaagccaggagagaattgcaagatgacccttcaggtcctcccagctctagtggtctctgttctgaggcttccggaccctataagagtgagcaggagggtgcaggcatttggggatggagcggcatgaagtgggctcctgggggtcagcagagcagccaggcgcaggacagagctgctccaagcaatcctgatgagagctggcagaaggctgaggtcggtggggatagtgaggagggcatgggtctgggtgtggtgggcgagggtgtctcgcccatctctgggttggacaggtgcacctggtaa

SEQ ID NO: 239 - DNA, 3149 bp, Homo sapiens
atggggtggctggacgagagcagctcttggctcagcaaagaatgcacagtatgatcagctcagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgcctctgagcccaacttgaaggtgcggtccaggttaaaacagaaagtggcagagaggagaagcagccccttactcaggcggaaggatggaaatgttgtcacttcattcaagaagcgaatgtttgaggtgacagaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacagcctttcctggaacccacgcacacacgtgcgctctctgtgcgccaagctccgctggctgcggttggcatggatggattagagaaacaccgtctcgtctccaggactcactcttcccctgctgcctctgttttacctcacccagcaatggaccgccccctccagcctggctctgcaactggaattgcctatgaccccttgatgctgaaacaccagtgcgtttgtggcaattccaccacccaccctgagcatgctggacgaatacagagtatctggtcacgactgcaagaaactgggctgctaaataaatgtgagcgaattcaaggtcgaaaagccagcctggaggaaatacagcttgttcattctgaacatcactcactgttgtatggcaccaaccccctggacggacagaagctggaccccaggatactcctaggtgatgactctcaaaagtttttttcctcattaccttgtggtggacttggggtggacagtgacaccatttggaatgagctacactcgtccggtgctgcacgcatggctgttggctgtgtcatcgagctggcttccaaagtggcctcaggagagctgaagaatgggtttgctgttgtgaggccccctggccatcacgctgaagaatccacagccatggggttctgcttttttaattcagttgcaattaccgccaaatacttgagagaccaactaaatataagcaagatattgattgtagatctggatgttcaccatggaaacggtacccagcaggccttttatgctgaccccagcatcctgtacatttcactccatcgctatgatgaagggaactttttccctggcagtggagccccaaatgaggttggaacaggccttggagaagggtacaatataaatattgcctggacaggtggccttgatcctcccatgggagatgttgagtaccttgaagcattcaggaccatcgtgaagcctgtggccaaagagtttgatccagacatggtcttagtatctgctggatttgatgcattggaaggccacacccctcctctaggagggtacaaagtgacggcaaaatgttttggtcatttgacgaagcaattgatgacattggctgatggacgtgtggtgttggctctagaaggaggacatgatctcacagccatctgtgatgcatcagaagcctgtgtaaatgcccttctaggaaatgagctggagccacttgcagaagatattctccaccaaagcccgaatatgaatgctgttatttctttacagaagatcattgaaattcaaagtatgtctttaaagttctcttaaaaattctaagcaggtaaaactaactaaaattatattgaaaattatagtacaaagaaacatttaaaaaaaaaa

SEQ ID NO: 240 - DNA, 437 bp, Homo sapiens
  misc_feature (203)..(203): n is a, c, g, or t
  misc_feature (415)..(415): n is a, c, g, or t
tagaataataaaaggaggctttattttaaaaaggggagagcaggatgtaggggaactgcaaggaataacacagttactccaaacaacaagagagctattaccacccttagacttgaagagacaagaagaagaccagttaccaaagcacaggagagagttggctagaggtggccttcttgagaggagcagtgggtgcaggccanggacacagccaggccaagatgagcacagggaggaaaaggggaatggtataattcactctccttcctcctgtctgtcttctgctggggctttgcattagcaaaagcgaacaaggcatctctgatgtggtccatacaggttggctcaccagacagagaaatgggtatgcaaaggtatgggtgtgtctatcaatactgagggtgttcaggggcangtctcaatccaagtggcacaga

SEQ ID NO: 241 - DNA, 3159 bp, Homo sapiens
gctgggagacgcctgggcgccgggggctgcaggtcccagggcgggggctgcgtccgtcaccggcaggtacccaggtatgccgcagagccaggcacgccgtgggcactcagtcagtatctgtggaatgaatgaatgatggtcgtccctgggagcttatctctgaggaatggcacaactagagaggagcgccatctctggcttcagctctaagtccaggcgaaactcattcgcatatgatgttaagcgtgaagtatacaatgaggagacctttcaacaggaacacaaaaggaaggcctcctcttctgggaacatgaacatcaacatcaccaccttcagacaccacgtccagtgccgctgctcatggcacaggttcctacgatgcatgcttacaatctttcccttcctagaatggatgtgtatgtatcgattaaaggattggcttctgggagacttacttgctggtataagtgttggccttgtgcaagttccccaaggcctgacacttagtttgctggcaaggcaactgattcctcctctcaacatcgcttatgcagctttctgttcttcggtaatctatgtaatttttggatcgtgtcatcaaatgtccattggttccttcttcctggtgagtgctctgctgatcaacgttctgaaagtgagcccattcaacaacggtcaactggtcatgggatctttcgtcaagaatgagttttcggccccctcctaccttatgggctataataaatccttgagtgtggtggcaaccacaacttttctgactgggattattcagattattggcttcactgtgattgcaaacaagataagcatggccacagaaaccagccagacgcttattgacatgattccttatagctttctgcttcctgtaacaccagatttcagccttcttcccaagataattttacaagccttctccttatctttggtgagctcctttctgctcatatttctgggcaagaagattgccagtcttcacaattacagtgtcaattccaaccaggatttaatagccatcggcctttgcaatgtcgtcagttcatttttcagatcttgtgtgtttactggtgctattgctaggactattatccaggataaatctggaggaagacaacagtttgcatctctggtaggcgcaggtgtgatgctgctcctgatggtgaagatgggacactttttctacacactgccaaatgctgtgctggctggtattattctgagcaacgtcattccctaccttgaaaccatttctaacctacccagcctgtggaggcaggaccaatatgactgtgctctttggatgatgacattctcatcttcaattttcctgggactggacattggactaattatctcagtagtttctgctttcttcatcaccactgttcgttcacacagagctaagattcttctcctgggtcaaatccctaacaccaacatttatagaagcatcaatgattatcgggagatcatcaccattcctggggtgaaaatcttccagtgctgcagctcaattacatttgtaaatgtttactacctaaagcataagctgttaaaagaggttgatatggtaaaggtgcctcttaaagaagaagaaattttcagcttgtttaattcaagtgacaccaatctacaaggaggaaagatttgcaggtgtttctgcaactgtgatgatctggagccgctgcccaggattctttacacagagcgatttgaaaataaactggatcccgaagcatcctccattaacctgattcactgctcacattttgagagcatgaacacaagccaaactgcatccgaagaccaagtgccatacacagtatcgtccgtgtctcagaaaaatcaagggcaacagtatgaggaggtggaggaagtttggcttcctaataactcatcaagaaacagctcaccaggactgcctgatgtggcggaaagccaggggaggagatcactcatcccttactcagatgcgtctctactgcccagtgtccacaccatcatcctggatttctccatggtacactacgtggattcacgggggttagtcgtattaagacagatatgcaatgcctttcaaaacgccaacattttgatactcattgcagggtgtcactcttccatagtcagggcatttgagaggaatgatttctttgacgctggcatcaccaagacccagctgttcctcagcgttcacgacgccgtgctgtttgccttgtcaaggaaggtcataggctcctctgagttaagcatcgatgaatccgagacagtgatacgggaaacctactcagaaacagacaagaatgacaattcaagatataaaatgagcagcagttttctaggaagccaaaaaaatgtaagtccaggcttcatcaagatccaacagcctgtagaagaggagtcggagttggatttggagctggaatcagaacaagaggctgggctgggtctggacctagacctggatcgggagctggagcctgaaatggagcccaaggctgagaccgagaccaagacccagaccgagatggagccccagcctgagactgagcctgagatggagcccaaccccaaatctaggccaagagctcacacttttcctcagcagcgttactggcctatgtatcatccgtctatggcttccacccagtctcagactcagactcggacatggtcagtggagaggagacgccatcctatggattcatactcaccagagggcaacagcaatgaagatgtctaggagatgaactagaaataaggggtcagataatgctggcaaatcctcctacccaaaaaggggtcaattgtccagagacctagactggatacgaactagcagtacttccttcctgactgtgactcctactacctgccagccttcttccttgctctgcgctgggatcatactcccaaatcacattactaaatgccaacaattatctctgaattccctatccaggctcccctcatttcaccttcagcatatattctagtcatgaatttccttcttcacacaccccacatctctgggctttgtgccagaccatctctaacttaatcctctcatccctgttcccctttctccaaagagatgaagctcaaataaaatgtataactctaaaaaaaaaaaaaaaa

SEQ ID NO: 242 - DNA, 1023 bp, Homo sapiens
caatcttgttggccctcaggcgatctcccgttggatgaaatgctcctgctgaaactcgagtcccctttgatttgccttcattaattattcatgattcaggttggaaggcctgctgacgaccccctgtggccgttctctgagctttcctgtcacatcgtttccttccacgctctttggttccttacggtcctgctccttctgctgtcagaggagcagagagttgatcttattcattctggatacggatactttctagttgatctggataatcaagataacgaccctcaacagcggcggagagggagcagccagttggtgtgtctcagaaaatcccgctgagttccgaggcctcctagatgtggaatcttactgagagttgttcccaggtcagagaatggagagagcctgtgcatgatgggatatccccgcctagatcttttagtgagtctctgcctcagctactcttaggatcagggggagaaccatggtgtcagacatccggaaagaagacgggatgaatgttttacctctgaagtacatcccaaatgtgggagttaacttcagctttgctggggtctatttggccagtgaaactctgcctggttccttcgcacatccggaagccacttcacggggggccgtcgcaactggaaccacacacttggcatcggcggttgagccaaatggggactcgtggtgcaagcaacgctccccacgtgttagcgtgcgtgagattcggttggcggaattttactaggtgtgtgttggtagagtggggctgaggttttcttgctcctgtggatgtataggaagtcaaaggtcctgcccagccctgcggtcccctcagtcaactctgttttggagacgtaacgatttggattgccaacaaatcaagaaatgttcaagcccttggatgtagggtaaagaaagagagatcagactgtcactgtgtctatgtagaaggggaagacataagagactccattttgaaaaagacctgtactttaaacaattgctttactg

SEQ ID NO: 243 - DNA, 1952 bp, Homo sapiens
ctacttcattctacggccgagaccggaggatgttccctgctcaggaggaggccgacaggaccgtgtttgttgggaatttagaggcccgagttcgggaagagattctgtacgagctgttccttcagtttcttataggcggggccactaaccaaagtgactatatgcaaagacagagaaggaaagccaaagtcttttggatttgtctgctttaaacacccagaatcggtgtcttatgccatagctttgctgaatggaattcgtttatatggaagaccaattaacgtgcagtatcgatttgggagttctcgctcttctgaaccagctaaccaaagttttgagagctgtgttaagataaattcacacaactacaggaatgaagaaatgttggtgggcagatcttcctttcccatgcagtattttccaattaataatacttctttacctcaagaatattttctctttcagaagatgcagtggcatgtgtataatccagtgctgcagcttccttactatgaaatgacagctccacttcctaatagtgcatccgtgtcttcctcactgaatcatgttccagatcttgaggctggacccagctcatataaatggactcaccaacaaccaagtgactctgacctttatcagatgacagctccacttcctaatagtgcatccgtgtcttcctcactgaatcatgttccagatcttgaggctggacccagctcatataaatggactcaccaacaaccaagtgactctgacctttatcagatgaataaacgaaagagacaaaagcaaacaagtgatagtgatagtagcacagacaacaacagaggcaacgaatgtagccaaaagttccgaaagtctaagaagaagaaaagatactagtattacctacaaatgaaacttacctacactgatcttagttctcttatgaaaaaaataagatgttatcccatcaaataaacaatgtcatggctatcttgtcttttgaaatatgtagtaataagacttatctctggtttgctgttcaatttttgccttgaacgacaaaagctttctaaaaatagtataatgtaccactttttgtatttgtcatgatatttttgacccattggcaacaaatagactattgtcattttattagtaccaatgatgaaatttcaccaaactattaatcaaaagtcacttattgaacacattgataaagcatcatgttccctttgattatcccctataaccaacactcaactacaaataggctgggattcaatgtggagtggtggatttcctgaaagaaagtagtgcagatatttaaggattgcatattgttcctaatgaggatgtaataaacaggcattagtacccctttcttttagtacctaaatatgttgtttctgagccatattcttcttcaggtttattttataaagtgaggacatatgataatgataccaaaggaaagataattatcatgaaaccaacttttggatcattccctttttatacaattgtgtatttatagggataccttcctcttctcacatattaattgtatgtcattaaaatcagttggctatgtcagtgtgtattattcacctcttttgctagcaaggtttgagatgctatattaacatttaaatcatgaaaatgagcaagtaaatagaataatattttattaatgtatgatatgtaatacttattgtctaaatcaagtttcctatttttggtttatttattttagaagaaaaataaaattatttgggcatttttgtttatagctcattacaaactagagtgatgaatatatatatttactaaagctaattgaaagagtcatgcaactcagttgggaattaaccactcaattcaatagtaaaagccatgcttggatgtttcttttgcatgttgcctagcattttatagatatttattatttaaaaaaataaagatat

SEQ ID NO: 244 - DNA, 2667 bp, Homo sapiens
gcctggaatagcctggctactacccctgcacctgttcccctgctgtccccaggcctctctgcctgaatctgcctctctctgcctcttttctcctgtccctccaggagtctctctgcctcaaccactctctctgccccttcatctctctgagctggtgtgtctggtcctaccctctgtttggggagctgtctggctctgtcccccacctcttggccagcctgtgtctcctgtctatgactgagcccaattgcctgttgcctttctgcaggtgtttccacgagcctatccctacccacctgtttgtttctgagtctgcctgtgtgtccctttctccctgtctctgcctgtcttccaagctcccctagcatcccctcctcccgcccatctgtctttctgtcccttctgtggtctgtctgttcctgtgctgtttctcatgcctgctttctttgtaacttcagttctcctactctctctctgtctcctctctgcacctttttctgccatccatcccatcctgctgtccgtctgctctgtgagtcatcccctctgtctgcctgtcactctctctagctgtgggtctacaccctcaatctttcaggccatttcccccaccatcaacacacaaacaaaccgctgtctccctccaagtgggtccagatagggggcgccccttctccacctcttcccccgcccagggccagaaggagggaaacgaaattaaaattaacatttcttctcaggaaaaaaaaaaaagtaccgctccagagcaggagcctaggcagccgagagggtgcccgaacctgagtctgagttgcggccacttcaggagctgagaggagcaggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccggccctccaagcgcaggatgcaggccgtggccaacgtgtccattggggccatgttctgcatgtatgggctcacagcaacctttggatacctcaccttctacagcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatcttctacctccgcattgtaccctctgaggtggagcctttcttatcctggcccaagatccaggccctgtgctttggagtcctgggagtcctcttcacggccgtcagtctaagctttatgtttgccaactgggccacaagccagagccgcatgtctggacactgataaggcctgctggcccaggtccctgtgcgcatgcacatggaggggtcagggccgctccctagggtccctcctgcccaacatgtggaggtggctggttcccatgaacgtggttgtcagaggcgggggacagcagaggctgcagactggcccacttccctcctccccagggatgccaagcttggatcatggccctaatcccaaccccaaccccatgggaggaggaggaagaagaggaggaggaggaggaggaggaggaggaggaggaggccaggtcctggtggagcctttgcccagcccagtcctctctgcctcctcctggctgaagctgtttgtcaggattaccctcgggctaaagaggaaaaataaagatgttgagctaccaaaaaaaaaaaaaaaaaaaaaaaa

SEQ ID NO: 245 - DNA, 561 bp, Homo sapiens
tagagcctgaggcagccctgagccagtgggagtgtgagagccctgctcctggtgaaggcacaacttctgctgcagaactcccctgcagggtcaggctactgctgggacattgcaagaatcactcatcagccaaaggatgaagagtcctttttatggttcaagctagaagccaagccagtctcctcacctgaaaaatgggaagagcaaaatatcctaccctagagggttgctgtgagagccgaaagcgtctatccacgtgaagcacatgggacagagcctggcacaaagaaaatgcttcccagcaatggaaagccctgatggagcccggtgtaaactatgcagggtgccagagcccccactgacagcgctggtgtccacatgtggtcacagggatacagcggcagcatcccaaagccctagcctggtccatcaccctcaaaactgcctctggtttgtccaagtctaccaggattcaagttcatttcagaaaagcagtggccagaaaccaaggcctggagggggctggggaggtgtcagggaagggatcagaggccaagctct

SEQ ID NO: 246 - DNA, 898 bp, Homo sapiens
gctgatggactaaaaactggccatctttgatcagagggatcgtggatttttgcaactttcctggccagacttcgtcaaggccctgccggcctgctggacactgattgatcaacagattgatcaaacagctcctcccctcactgagggcagatgcttgcttcaaggatcaaacagcccggctctgccaggcaccgcccagcagcagaaggttgtgcttcaagtctgcacagccctccaactttggatgtttcttagaccaccggggatgcaagtcttctagtcctttctattcagaccagcactgacggtgaaggagctgaggccagggttggccatgtggaggcgtagggagatggaacatcggggacgcactgcttctctcctgctcacgtagaacttgaggacagaggctctgtctggcatctgaagacccagcaaagcccagctctgccagcagcttgccaggacctgagaaagcccctctctccccgggcctcagtttccccagatgtacgtggagggattggcctaaatgagctcagcggatctcatggccccgatcctggcaggttggtgactggctgccctgtccccagccctgtgggggttcaaggtgtgagccttgtggtgggggtacacagggtcccccaaaattcatgtatatccagagcctcagaatgagaccttatttggcaacagagtaatttgccggataccattaggtaaggaccttctagctagaagcatcctggaatttccgggtggggccccaaatcccagtgactggctggagaaggacggccagagccacaggcagaagcgggcacgtggagacggatgccagaggctggagtgaagtggcccaaaggccaggcgcgcctgggcaccagaagccgga

SEQ ID NO: 247 - DNA, 786 bp, Homo sapiens
ctaacggggaaacatcctccgagaagatacaatctcaagggtgggcctggatgtgggcttccagagaccatctccctgaaccagatcttggggatgcagcgccccctggctcgccttcatcattctggacatccgggctcccgagacaagagcgcagcacgagtcgccagcgctcccgaggctccccttcgagcacctgcgtgccctacaaggtccacgccctggcaaccttcgagtgctcggctacgagccatgccagccgcctgtggcagacgctgcagcagttttgggccgatcacatctcgcggcccttctcgccacggcggccgccactgcgccgcatgccctccctgtccaccttctacctgctggaccacaacacgcgccaggccgagctgggcctcgcctacggcgcgccgtgcatgcgcctcagcaaccaggccttcgtgttccgcggcgggcggtggaccactgagagccagctggcgaggacgcggtcgccgctgctctcgcggaccgcctggggctggaaggcgcaggtgcagcggtccaaaagccaagtgttgctggaggagaacaactacctgaagctgcagcaggaactgctcatagacatgctgactgagaccatggcgcgcatgcacttgctggagaagcagcgcaaccccgaggtgatcccgacggctgcggcgcgcgccgggcagaggaagatgcgcaagcgcgcaggcgccagcgcgggcgtgctcatgatccagccgtgcgctctggactcgcagtgacgcaata

SEQ ID NO: 248 - DNA, 2871 bp, Homo sapiens
cggagggcgagcggcgccggcgtcatgtgactgcccggagttggtgccaggagccagaggggagccaggagcggagccgcgcggagccggggcccgagccggagcgcagcgagagcgcccgccgcacgcgcgcccgtccccgtcccctgcggccgccaacgccgcccggactggagccctgacattgctgcgctcggggggctccaggcagcccgtatcggggcctttatttctcgtcggcggcgccctgcaccgcgcctcgcaaagccaaacaccagagcaccctagaaggtttaactaaaagaatgctcatgtttgacccagttcctgtcaagcaagaggccatggaccctgtctcagtgtcatacccatctaattacatggaatccatgaagcctaacaagtatggggtcatctactccacaccattgcctgagaagttctttcagaccccagaaggtctgtcgcacggaatacagatggagccagtggacctcacggtgaacaagcggagttcacccccttcggctgggaattcgccctcctctctgaagttcccgtcctcacaccggagagcctcgcctgggttgagcatgccttcttccagcccaccgataaaaaaatactcacccccttctccaggcgtgcagcccttcggcgtgccgctgtccatgccaccagtgatggcagctgccctctcgcggcatggaatacggagcccggggatcctgcccgtcatccagccggtggtggtgcagcccgtcccctttatgtacacaagtcacctccagcagcctctcatggtctccttatcggaggagatggaaaattccagtagtagcatgcaagtacctgtaattgaatcatatgagaagcctatatcacagaaaaaaattaaaatagaacctgggatcgaaccacagaggacagattattatcctgaagaaatgtcaccccccttaatgaactcagtgtcccccccgcaagcattgttgcaagagaatcacccttcggtcatcgtgcagcctgggaagagacctttacctgtggaatccccggatactcaaaggaagcggaggatacacagatgtgattatgatggatgcaacaaagtgtacactaaaagctcccacttgaaagcacacagaagaacacacacaggagaaaaaccctacaaatgtacatgggaagggtgcacatggaagtttgctcggtctggtgaactaacaagacatttccgaaaacatactggaatcaaacctttccagtgcccggactgtgaccgcagcttctcccgttctgaccatcttgccctccataggaaacgccacatgctagtctgattgcctctgtgtcctgcctcagcgtgactccccactcacctggctctctctctgtcatgcctcccattatctaacacattttttacatgtacattttaatttgattcagctggtatgaatctctgaatttatatcatccaaaacttccatatggtcagtagtagatgttctctaatcctccctctccttaccacgggtcagacctaaagaatgtgaacactttttttttttttctggggatggtaagcaaacccttcttacagatacgtttaatgtaataagaacaagggaacatgtaaactaacataaccaattgtcagttctccatgtattcctcaaaagaatgtcagagtaaatgtattagaaatacagtatccagactgctagtccttgccagagacattcttacctctgccctgtgataatattttatgcttgacagtgaaaacaagtgtggcccattgcaccggttagctagaagtacagccagatttcaagctagtgcagtcacatcttccgtcattcttcacaaatcttgtcaacctggatcttagacttcatctgaatcgagttctttgccctcctttgtgcctgcagctcatatggaggtctttgccaccaatgggagatgagccaaaactttcgatctaggtgggtgatgtgtagcagttcaagggaagggtgctgtgttttcatagcatggagtcggaggagagggccatttagcagggggagcagaagaggcaattcctcctgggctaggggttgtcagtgaggtttcaacattttgttagctgtgtgcagcattcccagagcttcagtctctgtgcatactcagctttgtagaaccatgctgcaaagccatataccgatggggttatccatgcaactatctccattcctacaatgtccttaatatgagatcatcaaacattgatagtagggactccatggaatatttgcccagtaatggtaagaaatctttcgggtaagagtatggatggttcttcttttacccaatctgcttatagctttttttgtaaacagggaaatgttgagtggtacttgtattcccttatcaaattaatcacatagcttttatacagaaactcttcctgtgtgagctgttaaggtgccaaattggctgtcatttgtattcatgacacataccataaagcatctgctaatgctttaatggattgattcaattaagacctgagtgacactatttgtaaatataactagttgtgaagcacacatacctttattttgggaatttatgagaaaatatagaaaaccacagatcagggattcatatatgtagctcaaaaattcccaaaagtttactgttagagttggcaatttcctatcactatttcagtgtcagaacaaactgaaaataatggctcgtgtttatgttgaagataaatagcaccattattgggggaagttattcaaaagcaggcttttgagcaccatagtctaaatgccaataaaaataattcatacatagaaaaaaaaaaaaaaa

SEQ ID NO: 249 - DNA, 2911 bp, Homo sapiens
gggtgacttcgcgtagcaggcagggaactggccgcggcgagcgggactggccattggagtgctccgctgcggagggaggggaccccgactcgagtaagtttgcgagagcactacgcagtcagtcgggggcagcagcaagatgcgaagcgagccgtacagatcccgggctctccgaacgcaacttcgccctgcttgagcgaggctgcggtttccgaggccctctccagccaaggaaaagctacacaaaaagcctggatcactcatcgaaccacccctgaagccagtgaaggctctctcgcctcgccctctagcgttcgtctggagtagcgccaccccggcttcctggggacacagggttggcaccatggggcccaccagcgtcccgctggtcaaggcccaccgcagctcggtctctgactacgtcaactatgatatcatcgtccggcattacaactacacgggaaagctgaatatcagcgcggacaaggagaacagcattaaactgacctcggtggtgttcattctcatctgctgctttatcatcctggagaacatctttgtcttgctgaccatttggaaaaccaagaaattccaccgacccatgtactattttattggcaatctggccctctcagacctgttggcaggagtagcctacacagctaacctgctcttgtctggggccaccacctacaagctcactcccgcccagtggtttctgcgggaagggagtatgtttgtggccctgtcagcctccgtgttcagtctcctcgccatcgccattgagcgctatatcacaatgctgaaaatgaaactccacaacgggagcaataacttccgcctcttcctgctaatcagcgcctgctgggtcatctccctcatcctgggtggcctgcctatcatgggctggaactgcatcagtgcgctgtccagctgctccaccgtgctgccgctctaccacaagcactatatcctcttctgcaccacggtcttcactctgcttctgctctccatcgtcattctgtactgcagaatctactccttggtcaggactcggagccgccgcctgacgttccgcaagaacatttccaaggccagccgcagctctgagaagtcgctggcgctgctcaagaccgtaattatcgtcctgagcgtcttcatcgcctgctgggcaccgctcttcatcctgctcctgctggatgtgggctgcaaggtgaagacctgtgacatcctcttcagagcggagtacttcctggtgttagctgtgctcaactccggcaccaaccccatcatttacactctgaccaacaaggagatgcgtcgggccttcatccggatcatgtcctgctgcaagtgcccgagcggagactctgctggcaaattcaagcgacccatcatcgccggcatggaattcagccgcagcaaatcggacaattcctcccacccccagaaagacgaaggggacaacccagagaccattatgtcttctggaaacgtcaactcttcttcctagaactggaagctgtccacccaccggaagcgctctttacttggtcgctggccaccccagtgtttggaaaaaaatctctgggcttcgactgctgccagggaggagctgctgcaagccagagggaggaagggggagaatacgaacagcctggtggtgtcgggtgttggtgggtagagttagttcctgtgaacaatgcactgggaagggtggagatcaggtcccggcctggaatatattttctacccccctggagctttgattttgcactgagccaaaggtctagcattgtcaagctcctaaagggttcatttggcccctcctcaaagactaatgtccccatgtgaaagcgtctctttgtctggagctttgaggagatgttttccttcactttagtttcaaacccaagtgagtgtgtgcacttctgcttctttagggatgccctgtacatcccacaccccaccctcccttcccttcatacccctcctcaacgttcttttactttatactttaactacctgagagttatcagagctggggttgtggaatgatcgatcatctatagcaaataggctatgttgagtacgtaggctgtgggaagatgaagatggtttggaggtgtaaaacaatgtccttcgctgaggccaaagtttccatgtaagcgggatccgttttttggaatttggttgaagtcactttgatttctttaaaaaacatcttttcaatgaaatgtgttaccatttcatatccattgaagccgaaatctgcataaggaagcccactttatctaaatgatattagccaggatccttggtgtcctaggagaaacagacaagcaaaacaaagtgaaaaccgaatggattaacttttgcaaaccaagggagatttcttagcaaatgagtctaacaaatatgacatctgtctttggcacttttgttgatgtttatttcagaatgttgtgtgattcatttcaagcaacaacatggttgtattttgttgtgttaaaagtacttttcttgatttttgaatgtatttgtttcagcagaagtcattttattggatttttctaacccgtgttaacaccattgaatgtgtatttcttaagaaaataccaccctcttgtgcccttaaaagcattactttaactggtagggaacgccagaaacttttcagtccagctattcattagatagtaattgaagatatgtataaatattacaaagaataaaaatatattactgtctctttagtatggttttcagtgcaattaaaccgagagatgtcttgtttttttaaaaagaatagtatttaataggtttctgacttttgtggatcattttgcacatagctttatcaacttttaaacattaataaactgatttttttaaagaaaaaaaaaaaaaa

SEQ ID NO: 250 - DNA, 539 bp, Homo sapiens
gtttgaatgcttcatagcaaatctctttaatagatgtattagaataaaatgtttgttgcacatcaattctattatccttttttgtagaatgcagagccgaggtacacctgtgacatccaagactgctgccggttctggaccagtcctggactcagacatttcttcagtaagtcctggttccttccactggaagatggtattagaaaccaagatctaggtgctaggtatggaggctgctattggtgggtcattgcttctaggtcctctcagttgacacagcacagaaatgcaggtgtgtacactatcccatgtatgtacgtgtgtattttatgagtttatcgttcacgcaaaagtaatagaaatctgaaggagacttgaaaggcttgaggctgaaaaacatctaatttatggaatttgagaattgtagcatctctggggtagagttgggtgtttctctttgtggcagatcttctccttactctgataattgaaagctacagagaattattatgcagccgtggactctcaaaaatttattc

SEQ ID NO: 251 - DNA, 2420 bp, Homo sapiens
cctgctcccccgcggttggttcttccttgctctactcaaccctgacctcttctctctgactctcgacttgtgttccccgctcctccctgaccttcctcccctcccctttcactcaattctcaccaactctttctctctctggtgttttctccttttctcgtaaactttgccgcctatgagcagccacattgccttactgaaatccagagcctaaccttcaatcccaccgccggctgcgcgtcgctcgccaaagaaatgttcgccatgaaaactaaggctgccttagctatctggtgcccaggctattcggaaactcagataaatgctactcaggcaatgaagaagaggagaaaaaggaaagtcacaaccaataaatgtctggaacaagtgtcacaattacaaggattgtggcgtcgcttcaatcgacctttactgaaacaacagtaaaccatctttattatggtcatatttcacagcaccaaaataaatcatctttattaagtagatgaaacattaactctaactgtgacaaagaagaccacaaatagttatcttttaattacagaagagtttcttaacttacttttgtaagtttttattgtgtaagtttataatgcaggggaagtactactcctcaaatgttgagggaagcttccataacattgatgactggcttcatggcagtaattctcggctgtagttgcataagcattgctcaagaggaaaatccaaaagtgcagcaggagaactcttttccctgaaaaaggaaaaatattgaactcaatgatagcacctaaacttacatttaaaagacagacattccttctacatgtaatgacacttcttgtgttaaactaaaaatttacaagagaagaaagtgaaagcaaatggggtttcacaaatagttgtaaatatagtgaagcaatttgaaataattttcaagcaaagtattgtgaaagtattctaagccaagttttaaatattatctaacagacaagagtggtatatacaagtagatcctgagaagtacctttgttacagctactataaatatacatataaattatagaatctactttaatttattttgtgaacacttttgaaaatgtacatgttcctttgtaattgacactatatatttcttaataaaataattctcaaatttgtttcttatgaatcatctctcaaatctagttagacaatttgcacacatacttttctaagggacattatcttccttcaggtttttacctccactcatccttagagcccactgactgctcccctttatacctgttggccctgcctataggagagaatatttggagataggcagcttcaggatgcattgcaatcatccttttcttaaattatgtcactagtcttttattttttcccctcttgaactttcctcacacctggaagaaacaaagtaggaaaaagtgaacaggggatgtcaaatcgattcttgaattcccgctgcaagctagagccgcaggcaccctctcactcaatttccactcagaaccctataaacaccagtgggaagggcaacccactgcacgtgggaatgcactgatttttcctaggagtagacatgttcctctaattactccctgagggttagttggggctaaaccatgacagaagtggggaagttcaatgtccttaaatccatcttacttgccaacaggtaagaggaagcttacattacatgtccagtccacatttaaagagcacttactgtggaacaagccttcagccaaacaatggggatagaaaagtaggtaagactcagcctttgtccagagaagctcagggtatagctgaataggcagtttcttttgtcctgaggaaaatcaggacatgcctgctttctaaaaatcttcctctgaagacctgacccaagctcttaaatgctattgtaagagaaatttctttgtctattaactccattttagtagggattcactgactagattttactgaactatgaaaataaatacacataatttttcacaaaattttgggcccaattcccctaaaagaattgaggattagggagaaaggagacaactcaaagtcatcccattaagtgcagtttctttgaatcttctgctttatctttaaaaatttgtataatttatatattttattctatgtgttccatagatatcttaatgtaaaattagtcatttaaattacactgtcaattaaaagtaatgggcaagagattgcatcatactaatttagtaagaacgttcccaaatgttgtaacaatgtggatcatacatctctggttttttaaatgtattgaggctttcttggtggactagtatagtatacggtcagttatgtcaatgtttcatggtcaataaaaaggaagttgcaaattgtgaaaaaaaaaaaaaaaaaaaaaa

SEQ ID NO: 252 - DNA, 331 bp, Homo sapiens
  misc_feature (187)..(187): n is a, c, g, or t
tttgaaggcaggaaactgagtttttgtttattttgcatggaagtaaaatacaactttatttagcgaaaagaaggttttgagctaagctgttgtagaaggcaaccttctgcggtcagtgggcttgcagggcggcttgtggaatccagctttcccatgatttggttccccgtggagggtggaggcccantcagggggatgagagatgttctgagccaggataagcgtggaagagcctcgtgaggagcagagaggatttagacccacctggagtaagaatgggtgctgggaagtggccggaaataaggtgggaaggtaaggaggctctggctgg

SEQ ID NO: 253 - DNA, 933 bp, Homo sapiens
atggagaagtgcacgaaatcatcatctaccatgcaggtagagccttcctttcttcaggcagagaatctgattctgcggcttcaaatgcagcatccaaccacggagaacactgctaaaaggggccaagtcatgcctgccctggccaccacagtgatgcctgtaccatactcacttgagcatctcacccagtttcatggtgaccctgccaattgctcagagttcctcactcaggtgactacctacttgacagctctccaaatctctaatcctgcaaatgatgcccagatcaaactcttttttgattacctatctcagcagttagaaagttgtgggatcatatctgggcctgacaagagtaccttactgaagcaatatgagaatcttattcttgagttccagcagtcatttggtaaacccacaaaacaggaaatcaatcctctgatgaatgctaagtttgacaaaggagacaactcctctcagcagtaccctgctactttccacctcctcgctcaaaatctgatctgtaatgaaaccaatcagagtggtcagttcgaaaaggcactagctgatcccaaccaggatgaagagagtgtcactgatatgatggacaatcttccagacctgatcactcagtgcattcagttggacaagaaacatagtgacaggccagagctcctacagtcagagacccagctcccattgttggcttccttgatccaacaccaagccctctttagccccacagatccaccacccaagaaagggcctatacagctgcgagaaggccagctgcctctcaccccagccaaacgagcccgccagcaagaaactcagttgtgcctctactgcagccaatctggtcacttcacaagagattgccttgccaaacgttctcgagctccggcaacgacaaataacacagctcaccagtaa

SEQ ID NO: 254 - DNA, 6544 bp, Homo sapiens
atcgtttactttggttgtcccttctggcatggtgcatatgttatgggaagagggattataatttggtgctgtttgtagagatgacaacactgataaaatccactcattgctggtcccagcacacctggaaagttctgcaaggcctcagctacagaaagcccagagacagaaagtaaactctttcatgacccttgatcatcagatcatcaatccaactcttaaatggtcacaacctgcagtgccaagtggtgggcctcttgtgcagcatgcacacacaactctggacagtgatgctggcctcacagaaaacccactcaccaagttactagctattgggaaagaagatgacaatgcacaatggcatttatctggaagtattttggatgtgtatagcggtgaacaaggaatttcaccaattaacatggggcttacaagtgcttcttgtccaagtagtctaccaatgaaaagagaaattacagaaactgacactagagctttagcaaaagagagacaaaaaaaggacaaccacaacctcattgaaagaagaagaaggtataatattaattaccgaatcaaggagcttggcactcttattccaaagtctaatgatcctgatatgcgctggaacaaaggaaccattctaaaagcatcagtggagtacatcaagtggctacaaaaagaacaacagagagcccgagaattggaacacagacagaagaaattagagcaggctaacaggcgacttctacttcggattcaggaactagaaattcaggctcgtactcatggtctgccaaccctggcttcacttggcacggttgatttaggtgctcatgtcaccaaacagcagagccatcctgagcagaattcagtagactattgccaacaactgactgtgtctcaggggccaagccctgagctctgtgatcaagctatagccttttctgatcctttgtcatacttcacagatttatcatttagtgctgcattgaaagaggaacaaagattggatggcatgctattggatgacacaatctctccatttggaacagatcctctgctatctgccacttcccctgcagtttccaaagaaagcagtaggagaagtagctttagctcagatgatggtgatgaattataagaaataaacagacccaattcatcaactggaaagcaattctatgctggtgctatgcaattatgctctgtgtttcatatgttgctttggcttattttttttcttaaaggaatgtgttgttcatgaaaaactgatagaagcaacagaagaattcgcaggaagaaaaatcatagtgttaatgaattattgagggcgaaaaaaaggtgttttcttctttgactacggagtccaaatccacttaaattctgttttcctgaaaagaggtacagcataagaaatagctctttattgatgttttaaaagcagcaacttggtggtgtactactggaactaatgactgcaaagtgttaaacgactgaaatatacaaacagtctcttagttactcatttccatcttctcttcaactttcacatcagtcttccggaatcaagatcaacatatcaggtggtcattgcctttctccattgtctagtagacatgtctaaagttcaaactttataggataaataaatgtataatagattatctgtcacttgtggttgaaaggcaaatctacaataaatgtgagaattttccacaataaaatatggataacttataaaaacattggttactaaaattagatcctcattttattgtagttggttcaattacactaattctaaaagcatccatgcatatttatatctccagtctctgttcaggaaaaggaacatattgaatattttcctcaggaatatggaccagaattgtatcccttcacacaaacatacacatacacatatgcacatcattcaggtagtatatgttcttttgttttcttcatgcttctgactgcatcagaatcacattccaaattctcttttcttatgaagaagagatgtcagatcatcaattttagtaaataaaatataaaatgtccccctgcaaggacagttttcaggtacttaaaacttttcatcagtattggacagaaatcaattagttgttgatttggtttttctccaaatggataaaatattgaaaattgaattgccaattgacaaaataattattacaacaaactatttcttattattttcagttctgagaggaacgtaaggttctatttctataaacacttagagtgtcctatgatctttggttgcactgttagcatttattataagcacttataactatgatgcttcatttagatttttatctcttgcgcttgttttaggttaggaaattaagttaccaagcacgttgctctgtgctggacctccaagagtgatcatccgatcaatgagtattcatggaggcatactcagaactgcagtgagtcctgagaaaatgtagaagagttgaaaaagatatggtcttactcctaaggtagttaatgagaatgcatgaaaaacaaaaacaaaagatagaagacatatagaataaaaaatctaagcataaactgtaaatacagaaggtcagagaaaatgaaaatgactgacaaactttatgggaacagcagaatttgacttctctttgaaaggcattaattgagtgaaagtgagggcatataaaggaataataccaaccaaatgataaaagtgagaataataggggaagtatctttataggactttaattagaaagatctggatgccctagaagatgtctgttggggagttctgaagcataagactgacaacaggttgtgaaggcccttagaaaactatggtgaaataatatagtattaatataatagaaacaaatctttttagtagcagggaggatgctaaaaactaaaatatatattactaatgagtgagatgtaatctttcatgaatattaagctttgggataaattttgaaaggatcttttagttgcttctcacatggaaaatatgtcactatgaaatgtgagaccctaatgctgataaaagtagaaaaatagtaaatcattatggtataataattatctcaggcttagcttgtatcatttgctcagaatttggagaattaaaataattttattgtttgacatggaaaaataattactaacttctgggtacagtcattaaagcctgatagataaattcatctgaaatatgccatgtgaaacagctattagatacatcttctcaataattttcaagacgatattacatacttttaattttataacaaaattccacttcattatctgagttgataatttgattaaatgttaaaaattatagataaggaatatattttggagttcatagaaaacacaccactttattagatagagactggcttcagttctcattttatctgctcttctcatttcttcatattttgagtagacttgcactgatgatgtcattactcagtcattattttctgttctgttaaggtacaactactgggccttgaaatctatccttcacaatcttggctgagataaggacttggcacaggatgatagagcctggacacaagagatctggagagggaactgctatttgctgctacattcagattatgagatgtcagggaactgtaaaaagggtaatgaatttttaaagagagtaaagagttatgctgtgtcccggtcaactgaaatacattaaaaattaattagatggtagttcttaactttttaaggcagataccttgagaatctagtgagttatagaccctctccctagaaaagtatagaactgtttatatggacaataattcacatgcattcagagatcttagggatctcctgaatgttttcttggatcccaagtgaaaaattcctgaatcaggtctcttaggtgtgcggttaatgtcatgtataacaatggggggacccttacttatctaaatataattatcccaatcctaataatgatgaggttgcataggaaagtaatagtgtaccaaactttagattattcactaaaaaagttgttcatttatgaagtagtcgtttatcaaacatgtcctccccactcagcaaactatgccttctatttattatatatgggtcagtttcactataattactgagtgttataaacatctgaccataacattttgaaatgatgcaaataaatttccaaacaaaaatagtgtgaatttaaaagcaaattatttgagtatctaagaaacaagatagacttctagaaaaatttgactctctagaatatttcttgcagaaatgagatttttcataatagtaaaagaggcatatgtttatcaaacaatgctgtcacaaaaagcatcaactgtaatgggactattaatgcataattattgatttattcattcaattaatatacaattatcccttttcatttaaagatttaattcataattacaattataataaaacttcctttaaagtaagatacaataattttattgtttttcattcttttttcaacaaaatatcccatccaatcattttttatattattaaatattggctgctttttcttggattcacattaaacagccctttccaacttccaattgtcttaaaataatgatgacctcctgtgagtagatacagctctttacaatttttttctttagtgccttttcttcttgaatttttcctatatcaaatggagaatatatgtacagatggtattttctcagtttataggcatatcagtgaccatggctttctttatataggtttttaaaaaagccctaaataataaatagccagatgagctggggacattgagaaatagccttcctcttcctttttcaactcatttttttcccacctacatgactgtaaatcaaatatttaatagctcttacttaaaaaaacagatacaaagaatgtcttgatttggtgtgctcatttaccataatgtcatgaggggaattagatttcacaactttaaaaggaatatatttttattttattttgaaaaactgagtcatataggaattttcttatacttcaaggcatcatggaaacacttttttcctgtttggatattgtggaatttaaacgttcaaataaataaatggcataactaagtgttccaaatttttttacaatgtctttgaccctattcaaacactttaggtatttactgaccgtctgatgtgtaagatgtggaataaaactggaatcaattaattatttcactgtgttatcagcgcaagatcaaccatctgggtttcttaaagacacccgaaggattgaattttgtttcagtattgataatggcatagtctctatgtgctacatggaattacatcatttatccctccagtgccctatatgttgataagtatgtcagtttgacttagtatacatatatacagagatttcattacatttacctaataaatacaaaatacatttcgagtgttactgatctcctatgttacatgagcctcctgtaatcattgtgcattgatgttccaatgttttattgtttgtatgaattttaatttgaaaacaaggaaacaatccaaaagcagaaaaaatagcttttcttaaaattttcagtgctacattttccctctgaggtccatagagatttgaatgtataggagattatccgaaaacagctattttgattaaaaaatatatctcccaggattcaaccaacttaatgatgaagtactattgtctactgctttatacataaaagggaactttttatctgcttgtaaagggatttttatgtgtatttctgcataatcagatgacttctattgtgttttctactgatgaaattctctgtaaaatgtctttttcttacattatccaacaggcataaagaataacagtaaagacttttgtgtttgtaatactacctcttttatccctgcactactgttttattgcaaaaattctatattgtcactgtattttttccatagaatataaattttgttcttgtgctaaagctggtagtttatgtagcagacaaaatatacaaataaaagaagagactgattttgctgaaagaattatatataatcaagaagttacatattgttctttaaatatgatactgaattttaaaagcaaacgaaattcaagaatcttatctaacagcatagcagttgcttatggcatacaaggctaaaattaattcagctatttaatcttaataattattatgtagttaaaaatctttgactttaatagtgttttacatatacaaatagctgaagtaacattcctataattttaatctgacattggttagatcaagaaaacattgttaataagactgtagaatttgtaattattgctatttttcatttttaataacaaagtaatgtgtcttattttctaagaaaatggagaactttggtgtactttaatacatacaaaaatctttgtaaaaataccttaaaatgtaccaatattttctttgcatatattaaatgaaagactataattatgaaatgtt

SEQ ID NO: 255 - DNA, 533 bp, Homo sapiens
agttgttcgtaatacactttaatgaagttttctggatgtatatttcacaaaaaaaattgatttctaaacttgctattttctgtatgacttgtgtattaatgtattaattgaagttaagcaagaacaaaaaatattttctgaagcctgtaaaatggagagaaatgctcaagaatatgttttggaaggtaccagcaacagggcagctccagggttcacaacccttggaaccctgtccttagggtgtagttacgggataatttgttcaacctcttatatcctgggtctctctattgaaaatcccagttcctggaagagagaataggattggcctggtcatattccctattggtcacatgtcctgatttaccagagccatgtggagtcagagaggggtcattcttcaaaggccagggaatgagagggaaggaagactgcatggatgaaaataacctccaatctggacactgtcaaagccaacagacagaaaacaccaagatccaagaaggcatgcaggtaagaaacactgacaaagc

SEQ ID NO: 256 - DNA, 521 bp, Homo sapiens
  misc_feature (396)..(396): n is a, c, g, or t
ttttttttttttttttttgcctttgaaagaatttattacatacagctcccaagaggaggggcatgccacaccatgcagagccatatgggaaagtaccaagccaggaggcaaagaagtgaagcaaaatcatagcaaaggcctttactatgtagtggcaggaagctgttaggtggcaatgtcctctattgtgcaggaagtgagacacagatattggggtctatggttagaggtttataatatgatttcacatgcctgtgaaaggcttactgcaggagatataaacaactttggcctttagtttgaccctgtgatcaatggatgccaatttatcaattatataatctataaatgctggttagaacctctcacattttgatgttttgccaatatattcanatattagttcaataagggattagattcccatataaatggtttagtttgctcttcatgtatttccatgtcctaagggcatctcttgctggcaccactctgtttccaggcttcatcctgtcctctca

SEQ ID NO: 257 - DNA, 323 bp, Homo sapiens
ttaaaagatttactttttattctatgttcggtcttccattgtatttggaaccacatacatgtattagaatttttttaagtaaacaatttcttaaaaaaaaaacaaataaaatggctgggagatggtgaattactctagtagcagcagggagggagagactggagacaggataccagctagcaggctactgcaatggtctaagcaagagagacaaagactagggctaaggctgtcagtgaggatggagagaaagacctggctccaaggagcattctgcagatagaatccaaacttggatgaatgactggatataggggtgaaga

SEQ ID NO: 258 - DNA, 503 bp, Homo sapiens
tacatcatttgtttctatttaatcacaaagaagagggaagaatgactgaagcaagctgaaaacaacttgatttcacaagacagctataacaatatcatattaggtaagcgtaaatataaagtgatggcataagttattctgtgtacttatctactcagccagttcaacaaaaagagacacatcaatccccaacagtttttctgatggcacagtaaccactttttaaatcatttgctcaataggtaggagttgttggatagggatggattttgcttgtctgcttgagagcttgcaccaatatcttctcctcacagaaatacagtgagatgctaacctgagtctcagcttctggaagcagaaatagagggtcgggaagaacaaagcttagttacaattagtgaaatctctctcttcgttcttgtggaaatattctttcccctaaacttctggacattattatttgcatgaactgttagtaacaggcaaaatagaaaaccaacatt

SEQ ID NO: 259 - DNA, 489 bp, Homo sapiens
ttttttttttttttttttaaacctatatataatttattgagtagtaggcttaaaaggaaacaattcattcaagactttggatctgcatttagtttaaaaacattgtaaacactcaaaccttatcatgccaaagtaaaacttaaagagctattaaaaacaaatacattgttattttggttataattcctcctagaagaagtctaccagatgcatgcacaactaccaggggagtgaacatagcagccttcagaaagtgtcatgaaagcatagaccctcatttttccatcctcagcctccagcaggacaatacggggccttttgatgaccacgagcttcccttggttccttgtgctggcacttgcttggttttgtagtttaaaaccaccattaagaaaagactgtttgactgtttaaacagtgaactgccatgaactgtccttcaactcacttcagttggatgtgaaacagtaagatgaccaggcaggcctg

SEQ ID NO: 260 - DNA, 6864 bp, Homo sapiens
atgctgcggcttgtggtgcagtcggccaagattgacccaccactagccccactacccaggccctgcatgtccatcgacttcagagatatcaagaaaagaactcgtgtggtggaagggaatgatcccgtgtggaatgagaccctaatctggcacctctggaaccgccccctggaaaatgactccttcctgcaagtcacccttcaggacatgggctcacaaaagaaagaaagattcattggcctggccacagtactgctcaagccattgttgaaacaaccaagtgaggtcctttttgtgaaggacttgaccctgctcaaccattccatgaagcccacagattgtactgtcaccctacaggtggcccacatgagcaaccaggatattgagaagacaggagctgaagaccacctgggcataacggcaagagaggcagccagtcagaaactgatggtccctggctccactgcgcacagggctctgtcctcaaagcctcagcactttcaggttcgagtgaaggtgtttgaagcccgacagctcatgggcaacaacatcaaaccagtggtgaaggtgtccatcgcaggccagcagcaccagacacgcatcaagatgggaaacaaccctttctttaatgagatcttcttccagaattttcatgaggttcctgcaaagttctttgatgagaccatcttaatccaggtggtgaactcctcagcaatgagatacaaagcagagatcgggagatttcaaacagatattgggtttatctaccattctccaggtcacacactcctaaggaaatggctaggcctctgccagccaaataaccctggcagtggtgtgacaggctacctgaaagtcaccatctatgccctcggtgtgggagaccaggccctgatagatcaaaagctgctctatggcaccgatgacaccgatattcagatcttcaagtcagcggtagtcccgatcaacatggcttacttacagctcttcatctactgcgcagaggaccttcacctcaagaaacaccagtcagtgaatcctcagttggaggtggaactaattggggaaaagctcaggacacacatgcagacccaaaccgacaacccgatatggaaccagatcctgaccttccggattcagctaccctgcctctccagctacatcaagttcagagtcttggactgccgcaagaaggactgcccggatgagattgggactgccagcctgtccctcaaccagatctcgtccaccggagaagagatagaaggagtgtactccggcttcctgccctgctttggccccagcttcctgactctgcatgggggtaaaaaggcccctttcaggatccaggaagaaggcgcttgtattcccgactctgttagggatggtttagcttatcgaggccgagtcttcctggagttaatcacccaaatcaagtcctatcaagactccacgataaaggatctctcccatgaagtgaccaggatagagaagcaccagaaccgccaaaagtatgggctgtgcgtcatcttcctttcctgtaccatgatgcccaactttaaagagctgatccatttcgaggtcagcatcggtcactatgggaacaagatggacctgaattacaagcctctagtctcaagcacaccgtacagcccagtgatatatgatgggaacatctaccattatgtgccctggtacaacaccaagcctgtcgtggccgtgacctccaactgggaggacgtcagcttccgcatgaactgcctcaacctcctccacttcactcgggaccgcctgaaagccaacctggacaccctgaaatccacgcggaatccgaaggatccagctctcctctaccagtgggagaaactgctgagggagctggcagaggactgcaagcgccctctgccctgcatgacctatcagcccaaagccaccagcctggacaggaagaggtggcagctccgcagcctcctcctgcaggaactggcccaaaaggccaagcaagccaagcccaaggacatggtggccacagcggaggactggctgtaccgcctcaacaccgtgctccctgagccccagatgggcctccctgacgtgatgatttggctggtggccaaggagcagcgagtggcctatgcacaggtgcctgcccactccgtcctcttctccccggcaggggctctgcactccggcaggctctgtgggaagatacagacactcttcctacaggtgggaatcagggactcctcaggggaggacagggctgagaaatgcccccaggggagccccctgaactcgcagggcagcccctatggggcctgttttcctggtcccttaaccacatggaatggggttgaaacagtccccagaggaagagaggggtctgtggctgtcagcatgttgggtgatgccaagtccatgtacctcctaaatgttccccaaatccacctcctcgctgggcacggtggctcacagtacccagagggtgaaggacagaaggatgtgctcccagctcacctccgggtctgcatgtggcttggcaatgtcacagacagcaaggacctgcagctgctccgccagggtgacacagcggtgtacgccgagatggtttattccgagctttctcctagttcatcaacagcacgtgaagtgagcaaggctctgacttgcaggggcctcacccatcaccaacagggcagcccgggacccctgcaggccccagtggggtcccaggagtatgagaatcaggccaagtataaagaccagtgggggcagcaggggctgtatcactgccccaacttctcggatgtcatggggaacaagaccctccccatgacggatttccaaccacccctgggatggcactggcaggacagctggacagtggaacctcagagaaggctcctcctggacatagacatcaacaagagccaggtgctggaggaggtatatgagaaccagggccgtgacaccagaggggcctgggggcctgccgccatcccaaacacagacgtgaatggacagcccatggaggcccgggagaacgtgaagtgcccccaaggctggcactttaagaaggactgggtggtggagctgaaccacgcagtggacagtaagggctgggagtatggagtggggatcccaccgtcgggcctgccccaggtctggagcccggtggagaagacctaccactcgtgccgccgccggcgctgggcgcgtgtgcgcttcaggaaccatggggagctgagccacgagcaggagaccctctccttcctgcagctgggcctggccaagggcgaggaggagggctgggagtatgacaccttcggctccaagttccacctcaaccctcagccccagagccggttccgccgccgctgctggcgccgcaggctggcccccaacaaggacaagggcatcgcgcccatattcctcctggaggggtccttggcttgcgagggtggcagtgtgagggaggagggtgactgggcctgggctagaggaaacaggagcagcacccaagagcctcaggggagactgtcctgggtacaggctatggatctgaaataccacgctgggaaggaagaggacagcaagacatggccatggggtctggacagacagttcagggacccccagaggcaggacacccggccccccaacttgcccttcatctactgcaccttcaataagccccactactaccagctcttctgctacatctaccaggcccggaacctggtgtccaatcagatcctgacattccaagctgctcagcagtgtaaagacaggggcatggatgagggtgacaaagacgcagacccctctcccaagcagctcatggtcctgtggctgcagcagcagaggagaggaaagcccctcttcccagctcaagacactgctaccttctcctctacccctccagggcccttcattcgggtggtcttcctgaaccacagccagtgcacccaaaccctgaggagctctgcaggccccacatgggcccagacactcatcttccagcacctccttctgtacgagaacccacaggacaccaaagagagcccaccgcttgtggtgctggagctgtggcagcgtgacttctggggcaaggagagcttgtggggacggagcgtgtggcccccaatggtctggctggatctccaggaccggatcctgccccccatgaggtggcatccccttgtaaaggagttggggaaggaagagggcgagatcttggcatcctgtgagctgatcctccagactgagaagcttggagagaagcagctgcctatcttaagcgttccctggaagaatggggcatacacactccccaagagcatccagcccacgataaagaggatggccattgagatcctggcctggggccttcggaacatgaagaaggcgagctccccccagctcctggtggaattcggggaagagtccctgaggacagaacccatcagggactttcagaccaaccccaacttccccgagtctgagtctgtcctagtcctcacagtgctcatgccgacggaggaggcctatgcactgcccctcgtggtgaaggtggtagacaactgggccttcggccagcagaccgtgacgggccaggccaacatcgacttcctccagccctacttctgtgacccctgggctcaagactatatgcacccaaagcttccaagtacggcccttcctccgtgcctttccccaggcctcacaagcgagcctgcactgggagtggggcaggccctgctaccccgtgggttcctaggctacctctacagaaagttctggttcaagtccagtaaagcagaggatgagtatgagcatgaggtggactggtggagcaagctgttctgggccacagatgagcacaagtccctgaagtacaagtacaaagactaccacaccctcaaggtgtatgagtgtgagctggaggccgtgccagccttccagggcctgcaggacttctgccagaccttcaaactctaccaggagcagcccaagttggacagccccgtggtaggggagttcaagggccttttccgcatctacccctttcctgagaatccagaagccccaaagcccccgctgcagttcttggtttggccagagagagaggacttcccccagccgtgcttggtgcgggtgtacatggtacgagccatcaacctgcagccccaggactacaatggcctgtgtgacccttatgtgatcctgaaactgggcaagacagagcttggcaaccgggacatgtaccagcccaacactctggatcccatctttggcatgatgtttgaactcacctgcaacatacccctggagaaggacctagagatccagctctatgacttcgacctattttcacctgatgataagataggaaccacagtcatcgaccttgaaaaccgactcctatctggctttggagctcattgtgggctctccaaatcctactgccagtcagggccctttagatggcgggatcagatgcccccaagctacctcctagaacgctatgccaagcggaaagggctacctccgcctctgttcagtcctgaggaagatgctgttttctataatgggaaaaagttcaagctgcaaagctttgagcccaaaacccctactgttcatggtttgggacccaagaaggaacgccttgcactgtacctcctgcacacccaggggctggtacctgagcacgtggagacccgcacactgtacagccacagccagccaggcatcgaccagggaaaggtgcaaatgtgggtggacatcttccccaagaagctggggcctcctggcccccaagtcaacatcaaccccagaaagcctaaacggtatgagctgcgatgcatcatctggaagactgccaatgtggacctggtggatgacaatttaagtagagagaagacgagcgacatctacatcaaagggtggttatacgggctggagaaggacatgcagaagacagacatccactaccactcgctgactggggaggccgacttcaactggcggttcatctttaccatggactacctggcggcggagcgcacgtgtgtccagagccagaaggattacatatggagcctggatgccacgtccatgaagttcccagcccgacttatcatccaggtctgggacaatgacatcttctcccccgacgacttcctaggggtcctggagctggatttgtctgacatgcccctcccggctcggcacgccaagcagtgctccatcaggatgatggacgccgaccccaagtggccctatttcatccaatacaagcacttctccctctttaagaagaagactgtgactggctggtggccttgccaggtcctcgatggtggcaaatggcgcttgtcgggcaaggtgaagatgagcctggagattctgtcagagaaggaagccttaatcaagccagccgggcgaggccagtcggaacccaaccagtaccccacacttcatcctcccctacgcaccaacacctctttcacgtggctgcggtcaccagttcaaaacttctgctatattttctggaaacgctatcgcttcaaactcatagcctttatggtcatatcgattatagcacttatgctgtttaacttcatctattcagctccgcactatttggccatgagctggatcaaacctcaacttcagctgtatcctcccattaaaatattcaatatcatcaattcactaaacaccagcaacgccagctcttccatccttcccacccaggatccaaacctaaagcctacaatagaccatgagtggaaactccacccaggacccacaaatcacctgagtgatattttcccagaacttccagccccaggagactaa

SEQ ID NO: 261 - DNA, 1946 bp, Homo sapiens
acccactcactggtgagctccgcaagagtgtacttctctccgtccctggagcgccacggcgtgctggtgcatagtaagcatctgtccatgtctgtccagttgaatttcttgagagtcatttgaccttctcagcagctctggagaacccacattgaccagagactttgcagccagctcacccctccaaatccccgccctggagtccctgacccaggaatttctgcatcaggctgctcaaacctgaatttgacaaaatttcaaagcgctgtatctttatgttgataagacaacggataaagtgccatacttggaacctagatcactcaatgttgcctgtagctgagtccacttctgtcactcaccctgcattgccctgccaggagcaagggagagaaagccagccagaaggcatgggcatgggctcaaatcggcttctcctgtggccactgtgaaagttgatcatacaaaggtcactgttgtcatagccaagcagagttatgagaccacaggaaaaagcacttggaccacgtaacattgctccaagagtataactgtctccaaccctggctgctggaacaagtgttgcaacctgaaacaggtttgatctaatagctacagaaacaacctgcggaaatctaagactagtttcacccactcaccaatcagagcttgccggatccccaaaacgttgctagtgctaatgaacttgctttcctaacaatccataacatttctcatttttatgaaacctacaaccttctctttgctctttggacatactgaagaccacccagtctgtgtgtatgccccaaactgaaattcttgctccccaaataaaacattttaaacttagagatttgtctgtatattttatttgactttgacaacaccaggggctccggcacaaatctcctccttcaagcccttttctacacagtcccgtgggtctaccctgaaagaagcctgatgacggctcaaagacacaatgttactgggaggtaaattcaggattacttgaccgaatggcccacccgaggtcacggaggctgctggaggaacagaaaatggtcttcaccaagtgaagcattgtcggtcttggcctgtgtctggctggagaatgttaaaattctggggacacaacagaaaaggcacagttgtggggaccaggccaatgtcagcgtgagaactggctccatccccctcccatgaaccagctctgcggccaaggcaggtctgcatttcctggtctgtgacacggagtcagtaacattgcctacttcccggggctatttccagagaagtgagggaatgggtgtggaacgcctgccatctgcggagccccgcatgaaacgtctctgtctttccagccagccctgagccagggaagggactggaagcgcagcgggtggctgaggcgggctttcggcagcttacccccagccttgcccctccccgcctgctgaaacacaatctatggttgtcgccttcctggagatgttagccgccccctccagaggtggttccaaatctacttctcatttggctgatttaggagaggctgcgaatcggtcgctatggtttctttattttctcctgacagcttaggaatcatttttccaattattcccaggggaggaaaaagaagtggaggaagccagtgtttggaatgaggggaagctcacggatctgaaatgcaacctcttctgcaggagacccggcacagctaccgggacccatcacctccctgtaggaaccccgcccagccccctccagccagccctgcgtggttgtggccccactgcagaaacgcctccgcttaacactccagcctctcttctattcggtcaggccacagctgctgactttgtgcctgctgtagcaaccccgagcccccaaataaaccctccctcccagggtggcctctctacggggggagacagacggtg

SEQ ID NO: 262 - DNA, 322 bp, Homo sapiens
cagtgctttatattgtttcagtaggataatgatctgatagaagagatgacaggacttatggatggattggatgtaagtggtgaggagaaaggggttaggggccaggctgagtgcccagatttctgcctgagccactgggtggagatgagaaggaaagcaagttgcctcagaagacctagctcagagaagaagtgcttggatttgatttcagcttacttgatcccagggccatgtgcaggaccagctgaaacccacctctctgtacccccacccctggaaggactctggatccaggagccaaccagtacccagattccccagg

SEQ ID NO: 263 - DNA, 9271 bp, Homo sapiens
tacgaaccccgagccgccgccgccgccgccagcagcagctgcagcagtggcagctgcagtagcggcagcagccccagcctcaaggccagtttaagctatgaagaaggacatccctcacactctgaaacagatctccttcagagacagagttttgcagcctctcatcagcttcctggatatgctcccacacctcagcctactggtctttctggaatatttgatactagtgtgaacagtgccagcagtaacactaaagagtcttcagtgatgaattttctgtctactgctgaatcccgaactgctcaggctgctgcttcaggaactactctcttaccacaattcagggctccatcctggcagacaggcatgcattcctcagcagcaactgagctgtttgctactggacctttgccaagcactggaacacttccaccatctctctctgcttatcagcatcccaccaccttcagcaatagaaactttgctaccacttcacctttggtgcttcaggattcaacttttaacactacatcaaatggaattttaagtcatcatgaccctttgctacaaatcaagacttcccagggaactgttccaactgctttggcatttgagcgcctgggcagttctgtattaagtaacagcataccacctcagtcttcaacataccgctcagctcaagagtctgcaccccatcttttacaacctcaatttagtttgttgccttcagcacttgggggatcccagcagactcctcaagcctacagttcaactctctttactagttctactgcttccattgaaagagctcttcttcgagaatgtagtgttattaaacaccatcagcggccttcaggtacccagtcaattcaggcacaactgactggttcacagcactccttacatagttatctatcaaattcaagtgtagttaattttcaggaaacaaccaggcagtcatctttatcctgtagcccaattggagattccactcaggtgagcaacggaggattacaacagaagacctcccaggtctcagtggaacttgctcagtcttactcatctgcgattccatcatcagggtatcctccttctactacaaaaataaaaagctgttctacagaacaaccactgacatcaaccaagacccctaaacctcaaagtataattcctcctgtgcaaacactaagctattccaaacctttacataatcagagttctgtaatatcgggccaagcacaaatttattctacagcgcagctaccaagccttttatcagttagtcagtcccaaaattacggtttagtacagccacataatgtgccatctattgttcattcacaggtttataggtccagcaaggttgagaaattgccacccttgtataaaacattgactttttctgggtcatctcagactgtaactcctgaaaatcagacgcttaattattcatctaatcagcaagaggtattgtcttcagttacaaatgagaattaccctgctcaaacaagagatctgtcttcagtaagtcagtctcaaagttactcatctggtcactctcagggtttatcaccagttagccagacacaggttagctattcatctcaatcacaagttttgtcagttgttagtctttcagaaagctatgcttcaggggagtccctaacattaacagccccttctctttcttattcttctgcctctcgggctcagaatttgccagactctagcccgacccagaattatatttctatgcattcttcccaaaatgttcagactcaagagtcatcatctccccagtcccagaagtttttgcctgctgtccagtcatcatcttttgcatcctctactcattgtcagacattacaaaataacataacttcccctgacccaaagtcttatgctgaaagaaagcttgactcagatgtgtatccatcttcaaagcaagaagatggttttccaatgcaagagttacaggtgttgcagccacaagcatctcttgagtcatcaacccaaaggctatctgatggagaaattaatgctcaagaatcaacttataaggtgtcaaaggcagatgacagatattctcagagtgtaatcagaagtaattcccgtcttgaagatcaagttattggggttgctctgcaagcatcaaaaaaagaagaaagtgttgttggttcagtgacacaacttaaccaacaaattggccaagtcaataatgcagctacccttgatcttaagaactcaactaatttaatacagactccacaaataaggttgaatactaaagacttaaagcagcaacatcctctcatacttaaggtgcatgagtccaaggtccaggaacagcacgatcaaataattaatgcttcatctcagattcaaattccaaatcatgctttagggcatggccatcaggcatctcttcctaatacacaggtccttttagattctgcctgtgatttacaaattcttcagcagtcaatactgcaggcaggtttaggtcaagtaaaggcatctttacaagcacagcgtgttcaaagccctcaacaaatagtacatcccttccttcagatggaaggtcatgttattcaaagcaatggtgatcattctcagcagcaactccatcctcaaaattctgaagttatgaaaatggacctctctgagtcttcaaaaccattacaacaacatctaacaacaaagggccattttagtgaaacaaatcaacatgattcaaagaatcagtttgtttctcttggatcgatgtgtttcccagaggcagtgcttcttagtgatgaaagaaatattttatcaaatgtagatgatatcttagcagctacagcagcagcttgtggagttacacctactgatttttccaagtcaacttcaaatgaaaccatgcaggctgttgaagatggtgattctaaatctcattttcagcagtcattagatgtcaggcatgtgacttcagattttaactctatgacagctacagtaggaaagccacagaatataaatgatacttccttaaatggaaatcaggttactgtgaacctttcaccagtacctgcccttcagtcaaaaatgactcttgatcaacagcacattgaaacacctggtcaaaatataccaactaaagtaacttcagcagtggttggaccaagtcatgaagtccaggagcaaagttctggcccattcaagaaacagtctgctaccaatcttgaatctgaagaagacagtgaagctcctgttgatagtacattaaataataacagaaaccaagagtttgtttctagtagtagaagtataagtggagagaatgctacatcagagagtgaatttaccttagggggtgacgacagtggtgtgtcaatgaacccagctaggagtgcacttgcactgttggccatggcccaatctggggatgcagtcagtgtcaagattgaagaagaaaaccaagatttaatgcattttaaccttcaaaagaaaagagctaaaggaaaagggcaagttaaagaggaagacaacagtaatcagaaacagctgaaaagacctgcccaaggcaaacgccagaatccaaggggaacagatatttacttaccgtatactcctccttcctcagaaagctgccatgatggttatcagcatcaagaaaaaatgagacagaagatcaaagaggtggaggaaaaacaaccagaagtcaaaacaggatttattgcttctttcttagattttctgaaatccgggcccaagcagcagttttccactcttgctgtacgaatgcctaacaggactagacggccagggacccagatggttcgtacattttgtcccccaccacttcccaagccttcatctacaacacccacacctttagtgtctgaaactggcggtaacagtccatcagataaagttgataatgaacttaaaaacttggaacatttatcttcattttcttctgatgaagatgatcctggatatagtcaagatgcttataaaagcgtctctactcccttaactactttggatgctacttctgataaaaagaagaaaacagaagccctacaggtggcaactactagcccaactgccaatactactggtactgctactacttcctcaaccactgtgggtgcagttaagcaagaacctctccactctacttcatatgcagtaaatattctggaaaatataagctcttcagaatcctcaaagcccattgaacttgatggtcttccttcagaccagtttgcaaaaggacaggacactgttgccatagaaggttttacagatgaggaggacacagaaagcggaggagaaggccaatacagagagcgtgatgaatttgtggtaaagatagaagacatagagacttttaaggaggctttaaaaacaggaaaagaacctccagctatttggaaagtacaaaaagctttattacagaaatttgttcctgaaattcgagatggtcaaagagaatttgctgctacaaatagttatcttggatattttggagatgcaaagagtaaatacaaaagaatatatgtgaagttcattgaaaatgcaaacaagaaggaatatgtcagagtgtgttctaaaaagccaagaaataaaccttcacaaactatcagaactgttcaagctaagccaagtagtagcagtaaaacttctgatcctctagcatcaaaaactacaactacaaaagccccttccgtgaaacccaaagttaaacagccaaaagtaaaggctgagccaccaccaaagaaacggaaaaaatggaaagaagaattttcatcatcccaatctgactcatctcctgagatccatactagtagtagtgacgatgaggaatttgaacctcccgctccctttgtcactcgctttttgaacacaagagcaatgaaggaaacctttaagagctacatggaattgcttgttagcattgccttggaccctgacacaatgcaagccttagagaagagcaatgatgagctacttttacctcatatgaaaaaaatagatggcatgctaaatgataaccgaaagagacttcttttgaatcttcatttggatcaatcattcaagaatgctttggaaagttttcctgaactaacaataattactcgagattctaaagcaaagagtggaggaactgctatttctaaaatcaaaatgaatggcaaagcctataataagaaaactctaaggacttctaaaacaaccaccaaatctgcacaagagtttgctgtcgatccagagaaaatacagttgtattctttgtatcattcactccatcattataagtaccatgtttatctgatatgtaaggatgagatttcttcggtgcagaaaaaaaatgaagatttaggacaggaggaaattgttcaactttgtatgaaaaatgtaaaatgggtggaggacctctttgaaaaatttggagaacttctaaatcatgtacagcagaaatgttcctgacttttccacaaaaatcccatctttttatagcactaatgaaatggcagatatggggtggtcaaagataatcagatgtcaagtagtggccttctgcaggccggccgcttccatcatggaactgtcattaccacctctgctgaaggacagtggtgcggcctttaggaacgaagttagtcctctggaaatggacctaaatcccaccacatttttaccctaatgaatgatttttctattttgtaaaccattgggtaacttgagtcatattttcagaaacattttttgacaaatgatgaagcatgcactaagtataatttttttttattgctagagaagtaacacttaaagtaacgattttttttttctgactccggctaaacaccagaatgacagagaagtggcagaaaccatatgtttgtactcacatctggccacaaaaccagaaatactgtacattatgtaaagaggtctggtgtggtgtgacatcctgtataagaatatcatcaatttaaaatataaaatttggaaactattctgctttacagactccttttactcttaacatgttcaggaaactggatgtggaattggtgcaattctctgactgctttttgtgtcaaattatattgtgataaaaaaacaatgacatactattttccctatcgcaaagaaaagtattttcgtttatactgttttttcctttggaaaattttcaattgtacattttatttcactgatagttgtatttttcacaaggaaaatgttgtggttataattacgtttgatatatctctacaacaccttttgttattttcagtaaatcttagttatatgttgaatttctaatgtgaattctatcttgaggtaaccatttttttcatacagatttgcttcagtgttatccagaatatgcattcagtactagaattagtttagctttataaatagggctgtgttagacactgcagtaattttctaattcataaaataaacttcttactaaactagcacttgattaacttgttgaggtaaaaatctaactacatttacattttgaagaataaaactgataattagactatttgcagtgttaaacacagcttccttaactcttagaactggaagttgtagagctctccttttggtgcctttccagcctttatacacactattgtagctttcttaggtttgataggtagcgtttcaagtagtttagctgagacagtgaatgtattaggttcaacatgaccttgtgttttatttgtgtttgccaacaggatgccttatttgtttgagaaaaagatgtactagtgtcattctaaactatctccttttttaggattctaaagaagttaatcatcatccttttgtttattttaccaccatttagtgccttaaatcctatcaagaaagcagtgttactgctcaatgcccaaataagacacgcggatattgctattgtcttgcttttgagttaacaggccaactttttatacttaaaacctcagtaaactggcaaagaattgaaggtaatgtgatttgatttgagaataaaacattgtagcattgggtgaaaaatgagtatttgagttaagcttacatatttatttctgatggttatcttattaaaagcaataatccttaatactgtacttgccattagactaggtactcagtaatggaagtttctctcaagggttaaatgttccatttttgaaagttttaaaaaacctgtttgggtggtttattttgaaaacaaaagtaacctattagattcattttgcctaactcatatgagagatgcagagtatcaacagtgggagcatcataaaatgaattttccaagtggagaggagtaggaagcagccatatgatagtattgactctggacagaattgatgtctttcgtttccaaagtgcagagtagggaactacatttcctaatgtggcattgtaaatatacatctttatattactcttccagcctacgttcctaaatcattgataatttaaatattttttaaagccaccttaatttaggtagctcttggaatcgatgtttgaattcactagccacattttcttcatgatatgcctcgtggcaaacaaagatgtttccttaagatgaatcttacatttcccatagaaaataacccatttcctttggcactgcagttgccctcaaactgcttgcagttgtattcattttagtacaacaaaggttttcataatatgggaggccaagtctatgatactgcctcaaagagaccctattgtgtagatgcatcatcttctctcatttgatccatagagcataggcaaagatgtcaacctcaggccttagagaaaagtggaaatgttattatgacagccgtccatgagttatcgctttgtatgaagttaaatacagtcatgcgttgcttaacagcagggatacattctgagaaatgcattgttaggcaattccgttgtgcgaacatcctagtgtacttacacaaacctaggtggcatagcccacaacgtacccaggctatatggtaaacctgtacagcatgttactgtactgaatactgtaggcagttgtaacacaatggtatttgtgtatctagacatagaaaacatacagtaagaatatggtattataatcttacgggaccactgtcaaatacgcggtctgtctttgaaaagttgtaatgcggcgcatgactataaatacctagctggttagcatttacattccttgccagggagtttgaaatttatactatagaaataactttaggttttaggtagagttaaagaggtaaagcacatgttgccacaacccaggaaagtatttttaagaaagattggattttcctacctttagagatctaaaaaaaatttaatataaaaaatcattttgtgttggtgtttattactagttcagatgagtggctgctgaaggggcccccttgtcattttcattataacccaatttccacttatttgaactcttaagtcataaatgtataatgacttatgaattagcacagttaagttgacactagaaactgcccatttctgtattacactatcaaataggaaacattggaaagatggggaaaaaaatcttattttaaaatggcttagaaagttttcagattactttgaaaattctaaacttctttctgtttccaaaacttgaaaatatgtagatggactcatgcattaagactgttttcaaagctttcctcacatttttaaagtgtgattttccttttaatatacatatttattttctttaaagcagctatatcccaacccatgactttggagatatacctataaaaccaatataacagcagggttattgaagcagctttctcaaatgttgcttcagatgtgcaagttgcaaattttattgtatttgtagaatacaatttttgttttaaactgtatttcaatctatttctccaagatgcttttcatatagagtgaaatatcccaggataactgcttctgtgtcagtcgcatttgacgcataactgcacaaatgaacagtgtatactcttggttgtgcattaacttacatgtataatttttggcatctgtgttcacaaatgcatgtgttagcaaatcacctttatttataagtgacaataattgaagttaaggatataaagaaacctgcatttgtagtccagcgttttcatttggtccataacacaatgtatggaaatgtgaaagacaattttgtacatttgtttgttactaactcagatcattaaaatgaaaacaatttttttaaacaagaaaa

SEQ ID NO: 264 - DNA, 656 bp, Homo sapiens
acttgctgctggttgtaaatgtcttaaaatccttattgtcaaatcttgatgaagtaaagaaggaaagagagggtctggagaatgacttgaaatctgtgaattttgacatgacaagcaagtttttgacagccctggctcaagatggcatgataaatgaagaagctctttctgttactgaactagatcgagtctatggaggtcttacaactaaagtccaagaatctctaaagaaacaggagggacttcttaaaaatattcaggtctcacatcaggaattttcgaaaatgaagcaatctaataatgaagctaacttaagagaagaagttttgaagaatttagctactgcatgtgacaactttgttgaacttgtagctaattcgaaggaaggcacaaagttttacaatgagttgactgaaatcctggtcaggttccagaacaaatgcagcgatatagttttggcatggaagacagaaagagatgaactcttaaagcctgagacctgggaggaagctggagaaaagatgccctctgaatctttgtgtttggctgcccaggctcgccttgacaccgaatggttgaaaacagatatacaggtggggtttgacatgtctctttcttggtgtatttctgcttccatgtttaaatttctcgtgtaa

SEQ ID NO: 265 - DNA, 2433 bp, Homo sapiens
tgcctctgacaacccaacagtgtggagcagacccacagagagggagacccagagaggtgtgcagtggcatggaagggccagcggggtatctgcggcgggccagtgtggcccaactgacccaggagctgggcactgccttcttccagcagcagcagctgccagctgctatggcagacaccttcctggaacacctctgcctactggacattgactccgagcccgtggctgctcgcagtaccagcatcattgccaccatcgggccagcatctcgctccgtggagcgcctcaaggagatgatcaaggccgggatgaacattgcgcgactcaacttctcccacggctcccacgagtaccatgctgagtccatcgccaacgtccgggaggcggtggagagctttgcaggttccccactcagctaccggcccgtggccatcgccctggacaccaagggaccggagatccgcactgggatcctgcaggggggtccagagtcggaagtggagctggtgaagggctcccaggtgctggtgactgtggaccccgcgttccggacgcgggggaacgcgaacaccgtgtgggtggactaccccaatattgtccgggtcgtgccggtggggggccgcatctacattgacgacgggctcatctccctagtggtccagaaaatcggcccagagggactggtgacccaagtggagaacggcggcgtcctgggcagccggaagggcgtgaacttgccaggggcccaggtggacttgcccgggctgtccgagcaggacgtccgagacctgcgcttcggggtggagcatggggtggacatcgtctttgcctcctttgtgcggaaagccagcgacgtggctgccgtcagggctgctctgggtccggaaggacacggcatcaagatcatcagcaaaattgagaaccacgaaggcgtgaagaggtttgatgaaatcctggaggtgagcgacggcatcatggtggcacggggggacctaggcatcgagatcccagcagagaaggttttcctggctcagaagatgatgattgggcgctgcaacttggcgggcaagcctgttgtctgtgccacacagatgctggagagcatgattaccaagccccggccaacgagggcagagacaagcgatgtcgccaatgctgtgctggatggggctgactgcatcatgctgtcaggggagactgccaagggcaacttccctgtggaagcggtgaagatgcagcatgcgattgcccgggaggcagaggccgcagtgtaccaccggcagctgtttgaggagctacgtcgggcagcgccactaagccgtgatcccactgaggtcaccgccattggtgctgtggaggctgccttcaagtgctgtgctgctgccatcattgtgctgaccacaactggccgctcagcccagcttctgtctcggtaccgacctcgggcagcagtcattgctgtcacccgctctgcccaggctgcccgccaggtccacttatgccgaggagtcttccccttgctttaccgtgaacctccagaagccatctgggcagatgatgtagatcgccgggtgcaatttggcattgaaagtggaaagctccgtggcttcctccgtgttggagacctggtgattgtggtgacaggctggcgacctggctccggctacaccaacatcatgcgggtgctaagcatatcctgagacgcccctccctcctctggcccagcctacccttgtaccccatcccttcctccccagtctacgttctccagcccacacccctccaaagccccacctttaagtcctctcttctctattcctgaccctccctacctgaggcctatctgagactataactgtcatctagccccttcgaggttgccccttccccatctccatttcacacaggtcctgaaagtctgtgtccaattatgcactggccacccaacagcaccaattgtacattccctgcatccaatctgctcagcaggccctaagatgccttgagtctttaatcccagtttggctggttaattccataaccccaggcatcccatcccttggggtgggggagaggggagacagggcaatcttgtccacagtctcccattctcatatgtagccctcatgataatctgggcatctcgtgccagggcaggctaccccttcatggtgactaacagttacatgaaagtccacgcttttgggaaaactgggtgggatggatgctggggagaagtgagggctgggcagctgattttgtcactgtcttcacaacctccgtgctgggcttgtagaccactgtcctggctgctctcatgcctgcctgataccctgcttggtcaaatccccggctgcttccttctgcacccagaaattccttcccactcatgttgttcccacacacaaaccaagagccaaaaatgagtgtgtc

SEQ ID NO: 266 - DNA, 548 bp, Homo sapiens
  misc_feature (338)..(338): n is a, c, g, or t
ttttttttttttttttttgggttcaccattctgttttaatcatgagtgtatttgcaagatgccataaagaacctctaagatggtgatgatggtcagaggtggaatagggaaatacagcactctgttatcttgtagtcttgaggtaactcccttttcctaaggtctgttagcagtcagggcttctagatcagatgtaatgatggggcaggttccaaatagtgtacattccccccaattgagatataggaggggtctttcttttaggactttagggcacacaaagagagcgcttgtgcccttcagggtttgagagggtatccttctcaaacagctgtcanaagaggagctgggaaggctgtgagagaggcaagacagacaggggctgaggaaaaatatccaccagaagcaggctggtgtttggaggcagagccagctggagatcaggaagagtcttctaccaggtgggcagctgtgtgtctggaagtggtgacaggtggcacaggccagtgacaagaagatagccatgactaggggttgggtcttgagta

SEQ ID NO: 267 - DNA, 2872 bp, Homo sapiens
ttgatactctgtaaggtgggatgaaagcaagttttcttactcattttgcccagttgtcaagaaatgctgcccttctctctaacataaattaacaggtttggctacagcctagagaaatacaaaatgtcacattttagccttagtggccggttttcaaagggtgcctgagtgtgaacaccatgtcggctgctctgttaatgtgactgggtctcataaataggtatttttctacccctgtgatggacaaatctgaaaaagttttttcatcttacaagcccagaggatggtatttagaggctgatttttggtatctcagttcctggtagggaagacgaattccgtatttgaaatttggggacaaacaaaaataattctttctctttccttgaagggttaatgctccaaccagcctcagattggttcgcttgaatcttaaaattacttttctggtcacgcgcaccgaaggtctaagcatttgtgaaatgtcttttttttttttctttcctcttgatgctgttctctttgggctgtcttaattacacaggggttgagaaaccaaattaaaattaggcgtgtctggtcaacagtgatcacgttgcatgcttttagctttgcttgttgaagttgcttctcctccccgagtggctttcctccccacaattttttttttttgaaggaaatatcataagctctttcagaaatactcacaggaagtgagagtccgtatgctggttactcaccagcaactgagtgttggcaggtggagaatgctaccgcagcccgcccagacggatctgcagactggccccatcgcagaggattagacagagggtgcatggatcatagggtttttgaaaagaagggagttttaagaggaaattggtcactgcgtgtcatctcgaggggtggtgattcagggagcagggctgggggtcagaaggcacgtggctgccatctcagaggttgctgctcacttctcagagggcaggctggcttctaaaaatcaacgctccctccacccccaaacagcgattcttctgcagtgaatcacttccagaaatgaatagccacagttttttggaatgaacgttgtgaaatccctcctttataatggcaggttttcagttggtggttttatcagaatttctcaagatcaaaacgaaaccttctctttaaaaaggaaagaaagtactatcgatacagaaagcaaaagtatttccagtctcctactgaactgtcacggcagacctctctgtatctatatttagagctgtatgtccatatatttgcctgaatgtgtgagttcttggaagtatggattcattgccaggagctggtgatttcctaagcagaggtcgctaactacaagaaatgttacactcggacaagtcctgcgcttggggatcctctgtacgcccgttcactggtgcaggtcttctgaacaaatgcctcctgaggatttctgtgcctggaaaatatctgttaacagactgcttttacacctacatcaggataccgaagctcagaaaaattaaatgatttgcccaggatcacatagctagtaagcagcccagccagatcctgtgttaacttgttcatccgcttcctataagaaaacatccattcaaggcacatggggcaacaaagaaggacttagagctgtgtggcccctcgtcagggcagtaccagttgcacccatagtccggcctgaatactcagcttaggactattgtgtccaatgtcccaaacattttgaagctacatcttaaagaagtgtcctgctcagatgcagttctccttgtgaaatccgcaggccccaaggaaagtgactttaatccagtttgctcatgcaagaacagactggcatttcacatccaggaaaacaatggatttgtactgttcagcttttgccatgcaaggagttcctggtgtggtttattaatttacatctcaggctccagcttcactatcaatcagatttggaagaaaaaagttacaaagaaaggcagcttgctgagaaacagcggaagcatgacggtacagactgggttttgaaatggagacacattctcatggcttgtgggctgagagacactgagaaaggattttgttcttgaaagatgattgttttaatgctggagatggagagttttgacaattttaagtgcatgttctgtgtgtaagaaagagtcattacgttttttttttctttcagatgttgccatgccttaaaattgctgatgattaaaatagaacatcctgagttacagaaattcagccctagtgtatcctggcctaaaaatacagaacaatcaagttgattgttggaaatgagaggctaggcagggttggaaacatgctaatgtttactgagtgaaatctttccttctcagtagagttgcccttgcagctgaaagtcactgaaagactcaacaaaataagcagatcccacttgtctcactctgttctcctatgcatgccctggaaagagaatgaatgagccctttttaatttatcaactggttttcttccatctctttactagtgagccatgggggttttttgccgttaactgggtagccagtctcttcatggagacttattttcaggaaactagcctcttgctttatgtgaaaacaaggacccaactcaagatgtcttatcacagtgtgttctgttgcgtaacagttgcatctgtagtccagcctcaatactcaggttgggactgttttgtcctgatgtctcgaacatttcaaagctacgttcttaaagaaatgtcctgctcagatagagctctccttgtgaaatcctcaaaccccaggggaagtgaccttaagccagtttgctggcttttcatgtcacagaaaacaat

SEQ ID NO: 268 - DNA, 2100 bp, Homo sapiens
tttttttttttaagttattttctgtaatgcattttctgtgaatttattgtcttaaaaattggcaaatatggccattttgacatatttgccaaatatgagcatatggcaactatgctcttaatttgttaagtcaccaactgttggtggtaactgttgaaataacaaattaagagcaaagttatcaccaatctacgggatccttacactactgatattttcaataatgcaccgtagtcagacattgtagacttaacctctgagctgctcacaaaattactaaatcattctgaaatacgtaactgcaaattctgggctttaaagtctctagttaaatgggtgattttgaaaattggtggctgttcagacattttcaaatgagaatagaatgcatttgtttcagactgataaactgcagaaggttagataacaccaaacacatttgagtttctcctaagaaaatgacttgggcctccagattacatctcattttttttttttttttaccctatcaagtttgtttttccatatgaaatgtctttcccaactacacctgcccttggagactgtgaataacagacttaaaggaagtatcctttccagatgagctgaagaatgtcatcctcttaaaagaatgaacagctggtcatgtagaaattctctggaatgctcacttgtcctacaaaggcaggggagcagaaaacatgtagtttttttgttattggtatacataattgtaaatcttcgagataattttactagaagtccacataattttaataattgcctttctcctgaaaagattgctaataaattaacaatgtgaaggctagaaagctggccaagcataatccggtgggactcaggattgctggctggattgtcccgtttgatcagacattgtttcttagatgaatattcaggacgccctcgtgtataaaagttgtcctttgttctgactaccttggtattaagttcgaatttcttaccatgacacacaaaggattcgattcttgcttagctctctaagctcctctcactttctcttcccctcttgaattctttgctcttgccacacaactagcagatgaactaatctatctgttccaacgtgggcacagtagcagccgtaactcttaccttggcccactctgacttgtccagccctggttgaattcttcgtatccccgtgagggtccgcacgtagttggggctgtttactaaacggatgaacttccctaccgggaggctaggtctcggttatgccttacttcccaggaagcggcttctataggcattgtttaaatgtaggagtaggagggagctgggggtattgcattccccaggtcacagataaatgagattccaaaaccaagatctggctaggccttggaaagagggacctgcgaggccgaccagacgtttggaactgcgccttgcagtgtgggatctcagcaccggatattaccccggtttgtagagagttgagttactgttttaagagacgttgcaaaccgtacgggtcaagaagaaagccgaagacgggttagcgcctgcggtcggggtcgagaaaagcaggcgagatgcgacctgacgtgggtccgcctctctccacccgtggcaagcccgacagtcgcactattgctttaacaatcgccctctttccaagaagagctacttagtgaccgtgagcgaatatgcgtgggaagacacgatgtcctctcggcctctgtgcgctcagttgtttacctaggcgtccgggggaggcacactcgcgggactcgcgggactcggccccggcctcccagctcgcccaggacacgacgctggttctgcgggctctcggagcccagcgcgaatcccccgggctaattcccaagaaccgagaggcagcactgcctggaggctgcccccgtcctcctcactttctgaggctgttagcagagagtcccgcgggccggggagaagcgggacgcgggggatggcctcgcagcgccctgtgagcgtcggcagtagtcaggcagccagggctccttgggcgatcgccctgggtagaggagaggagtttccggggctcgggtccgggtcgccttccaggggaac

SEQ ID NO: 269 - DNA, 763 bp, Homo sapiens
  misc_feature (339)..(339): n is a, c, g, or t
  misc_feature (346)..(346): n is a, c, g, or t
  misc_feature (369)..(369): n is a, c, g, or t
  misc_feature (407)..(407): n is a, c, g, or t
  misc_feature (434)..(434): n is a, c, g, or t
  misc_feature (480)..(480): n is a, c, g, or t
  misc_feature (489)..(489): n is a, c, g, or t
  misc_feature (513)..(513): n is a, c, g, or t
  misc_feature (516)..(517): n is a, c, g, or t
  misc_feature (527)..(527): n is a, c, g, or t
  misc_feature (592)..(592): n is a, c, g, or t
  misc_feature (596)..(596): n is a, c, g, or t
  misc_feature (598)..(598): n is a, c, g, or t
  misc_feature (600)..(600): n is a, c, g, or t
  misc_feature (612)..(612): n is a, c, g, or t
  misc_feature (615)..(615): n is a, c, g, or t
  misc_feature (644)..(644): n is a, c, g, or t
  misc_feature (663)..(663): n is a, c, g, or t
  misc_feature (676)..(676): n is a, c, g, or t
  misc_feature (714)..(714): n is a, c, g, or t
  misc_feature (728)..(728): n is a, c, g, or t
ggatccccgggctgcaggaattcggcacgagctgtggcataggtggcctcccgctgaaagcctcacttgccctggcaggcaggggaggtaaaggacacgaggtcatttggagtccagtgccaggcagaggtgggatgcagggggttcctgaaagggggtgcctgggaggcttgcccatgggatgcttggactggtccccaaggatggggaagaataaccaccagccactgtccggaccctcgtcttgctccccagaacttgctgcagtgacaggtacaggaagaagatggggcagggctggagtttgagggaccaagggcaggagtggggatgacaggngcttccnccagggcctggggctggtgtccncggtgctccagggggcaagtcccagggttccagacccncactccagaccgcatgagaaccttggnggtgcaggcaagcccaccccggctgagatgtggctccaaatctggngaaggtacnctgtctgggcttggctgcagactntgnngtccctgtcngctgctgctcccagatggtagccaaggctttctctgtgctcactagtggtcagccttggccccangggncntngcacttgctggncantcactgctatctctagacccgatggccgngtcgggcctaacatcagcngtgtcgagctggntgacacaccttgccattccagctcagccacgatacctntgggtagtggcctntagctgttataatgagcatattgacaactagtaaa

SEQ ID NO: 270 - DNA, 558 bp, Homo sapiens
  misc_feature (21)..(21): n is a, c, g, or t
tttttttttgtatttaatggnaaaactttatttttttttgtctttttcttgtggaaaggactatcctagtcctctgaagatcacagtctgaaatattagagttttgtcttgtttattattcggttattacacatttcagaaaataattactccttaaaaatttctaactcactgacaccttcagtattcttcaatttttaaaatcagagattactttccccatgacttttgatcaaactatttcccaaacttaaaaaaaaaaaaaaatccctagaaaaagtacttactttctgatctagctgtggacacaaacacccattaccaaaaggggttatgaaatgacttgattgttaagagtgtggtagagaatttccactgtttattcatctggttagacagtaaaaacaaaagataaaaataaaaagaattttcctcgttgggtaggtttaggcaatcagtgaatgaagaaatatagcccaggaagcctcttacaccctttccagacacaccattctgtgatttaaaacacccaaagcaatgcacctatgaatttcaaga

SEQ ID NO: 271 - DNA, 970 bp, Homo sapiens
tgaattctctgcagcacagaagggagcaggtttgcattcaggccactgagacgacggaggctgcatcacagaagaggccgtgggaggtcacaggtacggcctctccttctgactgtacaatgaactctgcaagctgtgtggtcagagtgccagggacagccaggaactgctgtcatcgttccaggtggagctgacagactgtctccgaagcgcccacctgcgcgtgcgccccctcttcccggcacaggctagagatgcgcagaatcctaactacggccaccgtttcctgcctcaacgagccatgccctaaaagaaacaaatgcatcgccccagaattcttagaaagttacaatcatctgcttaactcttttaatttccttttccttcaacttaaactttaatttcaggtatcttctatacaacacagaagtcacgctctggatagaattaaaaggaaattaacttggggtttagggtggacgttttttgccttattttgcttcttagtaaatgaaagtgaagcctgaataatgagaatattattaatccatctccatttttctactttaaaggcacagcatagattttggttccagttgttactactttaatgagagtaatgaatattccatgtgagggcagtgtgcatgaaagtgtgctgggaaagttctatggatctttgtgttttggttcagttttgaagattaaatgcaagtttaatcctttaatgaatatataagtccggttgatgcccctttcttgaaaaagttatgggttaaattgggtgtggtcaaatcaatgggatttcattctgtctccagtgtggggggtagcaataaaaaggtgggtggggtaaggcttgggggggtaaatataggggggttttccttaagccaaccttaatttttgggaaaatggtaaggatttccaaaagggtaaagggtggtataaaaaaggctgtcctgccccg

SEQ ID NO: 272 - DNA, 480 bp, Homo sapiens
cgccctttttttttttttttctctcgcccagcgggttttatttatttcacaacacttttatggctgtgcttccagtgtgccaagcactattctaagcacctgaaacgtactgacccatggaggtctccagcaactccatgagttacgtactattcttgtccctattttctcagtgggtgaaactgcaaaacagggatgtaatgtaacttgcccaaagtcacacagctcaccaggagtagagctgggatccaaacctaggcagcagggctccaacgcccctgcctgtggccagggccctcgctgtgcctcttggcccagccccaccaaggcactggacatgggcactggagccctggatcaggagaggacaagtggtaagggcagggtgtgggaaagctgggctccagttccagatcactgctgctgcctatgaccctgggcaggcacccaaccgccctgccttgttcctaatctatacac

SEQ ID NO: 273 - DNA, 785 bp, Homo sapiens
atggcaggaccagggctagggccagggccagggccaggccatagtgagggcagggcaaaagccaaggcagggtcagggcaggtccagggcaggtccaggaagcggccagcaccaagcggggccaaggcacaaccagcgcagggtaaggcagggcaatggcaccactgggccatgacagggccaggtcagtgccaggagagggcagaacaggaaggcccatggtggggccagggcagggatgggccaaagcagagccaggacatttccaaggccaggtcagggccagaacaggagcaggaccatgaccactggcagggccagtgccatgacaggaccagggtcaggacaaggggcagggccagagccagggccagagccaaggtcaggccagtgcaggttcagggcagggccagtgccagggcaagaccagggcagggacagggtagcacggggccaagacagggtcaggatgggaccagagcaggacagggctgagagtccaggtaacagtagggcaggtacagggcaaggcagggcagtacagggccagatccacggcaggcacagggcaaagccaggcccattgccaatgcaccagccctccctacaaggctcctaccacctggccactgctgcagcccgtccatcgctgtaagcctgactcccaaccctgcctgcagccgcccgccctcctagcgtggccactctcctaccgctctggcgcactgcagtctccgtcactgccacccacccgcagcgaggtgagccgtggtgttgcaggctct

SEQ ID NO: 274 - DNA, 618 bp, Homo sapiens
caccatgccaggaggatgctcaagcagccccaaggagaaggccatgcagagaggacggaagcagccagtgacaacttgccagacacaggttgcgcccctttggaaatggattctccagcccctattgggcctttggatgatgtagcctcagctgatatctgactggaactgtatgaaaggcttcacatgagaacggtccggtcaggtccttctgaaatgcctgacccacagagacactgtgagatgaaagagtccaagacacacttatccatcacagcgatcatgcctgtaagaaaactcttcttactgcactcctacctggaactgaaagatgatgtgttcggcttcaatagatcctgctcttcacatcagggacagtagtcaatacttttgtatttggacactgggaatcaaggcagaagatctaacagaagatacaaaataattataatacattaattacaatagcaccatgaacacagtgttgcgctttctctgttctctctggctgcagccaggaaaggactcagaccaagaagaactgctggtgtgaaggacgtggcccgtgctggcctcatgcagtccttcctgcattcattagttgagcaatgcagaatc

SEQ ID NO: 275 - DNA, 381 bp, Homo sapiens
atggagaggaacacagatggcatagagcatccaaaagatggcatagagcatccaaaagatggcatagagcatccaaaagatggcagagagcatccaaaaggtggcagagagcatccaaaagatggcagagagcatccaaaagatgggatagagcatccaaaagatggcatagagcatccaaaagatggcagagagcatccaaaagatggcagagagcatccaaaagatggcacagagcatccaaaagatggcatagagcatccaaaagatggcagagagcatccaaaagatggcacagagcatacaaaagatggcacagagcatacaaaagatggtatgggggttgctgaggggactctggagtcccctgaaatcgcatag

SEQ ID NO: 276 - DNA, 2652 bp, Homo sapiens
agggagggtgtgacgctggtatctgtgtgaactcgggcttgtgatgctgagcttggttcatctgctttctcctcccttttcctccccactccttcccaccagcgccacagcaacatcctcagagtctgagcgaactgcgcccagcgcgggcacggagcctcccaccgccagcaacctgcggccccggagaaggcagcgagcgcagtgacagcgcctcaccgccaccagctcctggaccaccatggccaagaaccgcagggacagaaacagttggggtggattttcggaaaagacatatgaatggagctcagaagaggaggagccagtgaaaaaggcaggaccagtccaagtcctcattgtcaaagatgaccattcctttgagttagatgaaactgcattaaatcggatccttctctcggaggctgtcagagacaaggaggttgttgctgtatctgttgctggagcatttagaaaaggaaaatcattcctgatggacttcatgttgagatacatgtacaaccaggaatcagttgattgggttggagactacaatgaaccattgactggtttttcatggagaggtggatctgagcgagagaccacaggaattcagatatggagtgaaatcttccttatcaataaacctgatggtaaaaaggttgcagtgttattgatggatactcagggaacctttgatagtcagtcaactttgagagattcagccacagtatttgcccttagcacaatgatcagctcaatacaggtatataacttatcccaaaatgtccaggaggatgatcttcagcacctccagcttttcactgagtatggcagactggcaatggaggaaacattcctgaagccatttcagagtctgatatttcttgttcgagactggagtttcccatacgaattttcatatggagccgatggtggtgccaaattcttggaaaaacgcctcaaggtctcagggaaccagcatgaagaactacagaacgtcagaaaacacatccattcctgtttcaccaacatttcctgttttctgctacctcatcctggcttaaaagtagctaccaatccaaactttgatggaaaattgaaagaaatagatgatgaattcatcaaaaacttgaaaatactgattccttggctacttagtcccgagagcctagatattaaagagatcaatgggaataaaatcacctgccggggtctggtggagtacttcaaggcttatataaagatctatcaaggtgaagaattaccacatcccaaatccatgttacaggccacagcagaagctaacaatttagcagccgtggcaactgccaaggacacatacaacaaaaaaatggaagagatttgtggtggtgacaaaccatttctggccccaaatgacttgcagaccaaacacctgcaacttaaggaagaatctgtgaagctattccgaggggtgaagaagatgggtggggaagaatttagccggcgttacctgcagcagttggagagtgaaatagatgaactttacatccaatatatcaagcacaatgatagcaaaaatatcttccatgcagctcgtaccccagccacactgtttgtagtcatctttatcacatatgtgattgctggtgtgactggattcattggtttggacatcatagctagcctatgcaatatgataatgggactgacccttatcaccctgtgcacttgggcatatatccggtactctggagaataccgagagctgggagctgtaatagaccaggtggctgcagctctgtgggaccagggaagtacaaatgaggctttgtacaagctttacagtgcagcagcaacccacagacatctgtatcatcaagctttccctacaccaaagtcggaatctactgaacaatcagaaaagaaaaaaatgtaatgcaaattttaagaaatacaggtgcatgaccaattgtcaattaaatattcagttttatgtctccatgcaaacattcaaagtgcttccatcagaacggagtaaaatactaaacacctctgaagactgcaaactggattagttcttttacttcagtgtttaataagcagatgtatgtatgcatggttatactattttgttaacatgtacaatttcctgatttttcttcaaaaatgctgttataaagtatttgtctatttatgataacagtacacgtgttctgcttgaatttactaaattctactactgggttataattaaatcatgtgatattccacgtttggatatgctcatttaatttctacagaaaaaattttaaattatttcacattagccatttgttaaaacacagcatcataactcagcaggctggatttaatctgtatcatcttatatatatcacaatcttatttttaagcacattttagagttccttagttgctttatcaaaaaccagatattgcttttacatggtttaatagaatataaacctcttgataaaaaatgcacaaaaaatcactttgtatatgtgagtttcactgcattgtatattttttcatttggtacacaaagaatgtattcttcataggtttattcttttaatatgtgaactattattaaagtttactctggttcctaagattaaaaacaaatgcttactgaatttgaaaaaaaaa

SEQ ID NO: 277 - DNA, 2960 bp, Homo sapiens
caggaccagaacccacaatagccagtgcaaggatccatccctcctggctgaggtgggcctgctgtctcctgtgtgcggtttgccgagtgctagcacggcacagtggaggatgggtttggggcagcgagtcctgggtttgaatatgcagcgccactgtgagtgagctggaaatgtgaagcctggagcaagctgctcatccctctaagcctcagtttcctcctctgtaaaatggggctcacggtatcaccttcctcagccgggttaagcaaagtggcaggccccactgatggccccacctgacacagacttccctttctctgcccacctgcagcagcggcccctgaaacagtccctgggaagctccctgtgccgcgagtcgcactggaagtgcctgctcctcacgctgctcatccacgcctgcggggccgtggtggcctggtgtcgcctggccacagtgccgcggctggtcctggggcccgaggccgccttggcccggggagccgggggcccgccaccgacctacccggccagcccctgctccgatggctacctgtacatcccgctggccttcgtctccctcctctacctcctctacctggctgagtgctggcactgtcacgtgcggtcctgccaggcgccacgcaccgacgcccacacggtgctggcgctgatccgccggctgcagcaggcgccgccgtgcgtctggtggaaggccaccagctatcactacgtgcggcgcacacgccagatcacgcgctaccgcaacggcgacgcctacaccaccacgcaggtgtaccatgagcgcgctgacagccgcacggcccgcggcgagtttgactactcggcgcacggcgtccgcgacgtctccaaggagctggtggggctggcggagcacgcggccacgcggctgcgcttcaccaagtgcttcagcttcggcagcgcggaggccgaggcctcgtacctcacgcagcgggcgcgcttcttcagcgccaacgagggcctggacgactatctggaggcgcgcgagggcatgcacctgaaggacgtagacttccgcgagtcgctcatggtcttcgccgacccccgcagcccgccctggtacgcgcgcgcctgggtcttctggctcgtgtcggcggccacgctgtcgtggcccctgcgcgtcgtggccgcctatggcacggctcacgtgcactaccaggtggagaagctctttggcgccagctcgcccccgccgggggccgtgcccagcgggcccccgctgtcccgcgtggccacagtggacttcactgagctcgagtggcacatctgctccaaccggcagctggtgcccagctactcggaggccgtggtcatgggcgcgggctcgggcgcctacctcagaggctgccagcgctgccgccgctctgtcagcagcaactcgctgccccccgcccggcccagcgggccccgcctgcccttcagccgcagccgcctctcgctgggcgctggcggccgggccacgccaggggtcttccgcagcctgagcggggggccgctggggcgccgtggagaggacacggaacccctggagagcccgccctgctatgaggacgccctctacttcccggtgctcattgtccacggagacagcggctgccagggggatgggcagggtgctctctgagaccccccacggcccccagagtggccccctccccaccattccaccatgggcttagatgcccgagtgattgttgtccaaaacaggcgggaaaacagaccagccacacacaaggggcaggggtgagggtgggggtgggggtccttaaacagactaaaatgcagttacctgtggtcattttggaggaagtggaagcctaagaatcgcccccagcatggcttcatcccccaagatggccgatgatctggcctgaaggcctctcacaaagggcaggagaagaagcttccagaaaggctgggatggaggaggagtcctgcggccagctgttgcctgcagcagaggctgcctgtggacacttccctaccggggctgaggccatgctgggagcccccccagtgacgcagaagcacaaattggaggcttggggccatgcccagccaggttggcttccctggggctgaagagctggctgtggtggcaccatggccttggccctgctactcacccaacattcccatcctcccctgataggcccctcctccttgcctgccctctctcccgctgctcagggccagtcactccccccacatgcagctacccctacaacctggggttccttctcagggcctcacctggtccccacatcccctggcctctgctcctgcctcccaaagtccatgtctgcctccatcagccacacacacgcagggacgcccgttccttgccctcccggacttatctactcttcactttcctgatgatccatggggcccaggcctagagggcatccgaggggctgggccttggccacagcctcttggatgatgtccttgctccaccacgcaggcccttgcttctcccatcaacgagtcttggcccaggggacactgaccctcccccagggaggagagaggagttccttccctttcaacgagggcttccacgccctctaaggggtggcggggaagggaggaggctgagaagatgcagattaaataaaggtatggaatggaaggcctgtgcattcctgggtcatgggtctaaggcctccactgcaagcattatgggcccccatggttcagggcacgatgaggggttctgggaagggactcagaattgggctccagtgttcccaggaaccaagtaagcagaggagaggaaacctcccctgcctagcctggggcctctgagactcaagtgtgaggcgctctgagcacctggctcccctgactccggtatctgggcctgggtcactgctaaggcattgtcaaggtggcccttgttccagctcagtgggaca

SEQ ID NO: 278 - DNA, 349 bp, Homo sapiens
tttttttttttttttttttctgcattattccatttattgtatatagtatactagtatatatagatatatactatctacattattatagatatatagtacatgtcatatagtgtatacaatatgtaatatatacagtatatacactatgagatatctagacatatataaactatttatttatacatatatactatatatatagtatatataatatttttcatttatatatgccaaatgacaaaaaacaggctatgctgctggaagttgggatagcagtcacccttgggagagaggggtagtaactggaaggaaacacgaggagggcttctggatgctgttaggcctgctt

SEQ ID NO: 279 - DNA, 2283 bp, Homo sapiens
gtggggcccagacccgcgcaaccaggcggggaggggaggtgggcgcgcgattgggttgcgatctggagcagtggggacaggtcaggaaccggcgcgtatttctgcagtgagaccacaggacggacatcggcgccttcggcttcgatggagttgcgattctgctctttccagggaaacagtggcagggtgtttgctgcttatcggttcctgcggatatgcctgggtcccaggacattccactggaggcttggactgcatttaggagcccctatcccttccctgtccacactgttagtgagcaatttcatatgtttgcatttagacccatagactcagaacgactcatcacacacacacacagtgtacactgacacactcacattcgcacacttaggtatacagcctgatccttgctctgacctggtaacaacgcttcctcctccagagactttgagatagagcgagcgatccctgtgcaccattcatccatgctcccacctcgccagtatggctggcttagttctggaaggggcttaagaggaacaagccccagctgtgcttctggctgggacttaaaccccccttctgggccctaaagccacgcttctttgtggaccggacctgactctccaggaatctgggaacccgctatttcactctattttgggacaagaaaaaggggctctttggggccacttcctgccttcccctcaagtaggatctccagcctgcagagggtgcctagtccttctttgcccaagaaccagtccaagaagcctttcctctgtgcctgggaaatgcaaccttttcttgggagcatggtagggtgttggtgctgaagaaccaagcagcgacccgtcttgtagctgccatgttttgtcgaggggttctgggggtcctgctgctttagagccacatacttccacttcctgattcactactgtgagctggtcagatgcctagaagaggaacaagcgttcaaagtgaaagtgggcacattaccggaatagtgctggggagagtgctggattcttttccaccccaggcggactggtgagaagccaggcttggacctgtcctctgctcctagcttgcacactcagccctaaactcagagcagcacgcataccacccctcacacacaccccaccatctgctgtctaaggcccctgggcttcctgcaggatccagaccaatgtggctgggcttgggcttttatctgtcctgatcctggatttgtcctgaccaatgtaagtgtcgcccaataaaaccttctatgacccccacaccagccacccccccaccaagtgtgccctttccttcttgactttttagcagttctgggtaaatattgatttgcccccagtttaccttctccctgactggccatttgcagactcaggaactagcctctgtagggacttgatttttctgttactttctggccgtttcaccaccccccttcctccctccaagtggcattgtaaaactcacagtgacaaagagacagagtagggttctaggcccctgttcctggggacttgaaggcggttttacatactggtcagacacggctggaggccaaggtcaagttgaaagttgcagtccagccagcatgagaactgccatgcgagcgtagagacacaggcagcagcaaaaggcccattgcccacatcccctcactcttaattttctctctctttttaaaattctcgcctctgactgttcggctgcccagaattttttggtgccttcgtggggtttttggggcggtgtttaccgactcttctctgcctccgccctgctcagccagggctttgagcctcttcggttttccggccagacccggaaaaacgaaaacacagcttggggagcccccactagccggcgcctgtgccagctcacctctggccatggcgcagctgccggtgcacacggcggccaaggccagctccacattcttccctccccctcccacttcaccgtagccccgaaccctgcgcgcagagaaagggtctcagctccacagacgactgggtccctcctcaccaaaaatggtgagacaagatttcatctgtcggccgaggagccacaagcaggtttgtctgagagggatggtgctgggggaaggctttggattgcatctcaaattaagctttgctccttaaatgtggcgctctcgccaagaaaaagcttggggcctgaattcttgagatttatggtgcaccttattgatcaaatttatctggactttttttagttccccgatgtgtccctatcatt

SEQ ID NO: 280 - DNA, 771 bp, Homo sapiens
atgggctgtgctcgcaggcatgcgggacccagaggcagcccggtgaagggtagtgggggactcgactcactgtgggcctggggaggtgtggtttctctctgctggcttagttacaggtggtggcctgtctctccggggtctggctgtagccatgtccctgcacccaccttgccagccagggacaggccccatcaagacccaggagcagctccagcctcagccagactgtccccgaggtcccaagtgaggccccagccactcaggcatgcctcaggaagctcctgctgcacatgctcctctccctgcgccagcaccctgctgtctggcttccttcctttggccacagggcgggtgtgtgtgaaaccacagggtttacagaagctcgaggtgccactgagtggcaggattatgcactgcactcggggaatcaaaggtggagacagaaagaactatggctgttgtgacacgtcccccacggctccccggttggcagccactgccacccgcagggacttttctgtggcttccagaggtgtggggcaaaggtggagtctggtgactttctccctagggccagcccctgggctgtcgagcctgggaaactccacatccctctccacacctctagaaggactcacaatgaggggggcccagacaggaggcatcaccacctggtttgggctttaccattcacccagggataaggcaaggcaaacaccactccacatcagatctgaatttgagctctggcttcatgacactgacacatga

SEQ ID NO: 281 - DNA, 2023 bp, Homo sapiens
  misc_feature (1010)..(1010): n is a, c, g, or t
atgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtggacacctatgacgtccaggtcacagcccctggggccccgcctctgcaggcggagaccccaggcagcgcggtggactaccccctgcatgaccttgtcctccacaccanctacaccgccacagtgcgtggcctgcggggccccaacctcacttccccagccagcatcaccttcaccacaagggctagaggcccctcgggacttggaggccaaggaagtgaccccccgcaccgccctgctcacttggactgagcccccagtccggcccgcaggctacctgctcagcttccacacccctggtggacagaaccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgaacgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctga

SEQ ID NO: 282 - DNA, 367 bp, Homo sapiens
tccacacaaagctgcagatttctttattgagatggagttgagaaagctttaaaacaggccaaagcaacatgaggacatgtgtcatgagaagagaaatggtcttccataaattgagtgctggggaaggcttggtgtaggtaatgtagaggttctcaaactgtggagaagctcaaaatgtgttcctttgagccttggtcttctagttaggccactgtctaagccactatacaaaaagacaccaaacacactggcttcaacaagacaagcctctgtttctctttcgggtgacaggagaagcagaggactaagctttcttttccaagtcatcacctgaaagttgccccttcacttctgctcacattgcatt

SEQ ID NO: 283 - DNA, 456 bp, Homo sapiens
tttagtgttgggtatgtcaacccatgagacaaccatgatacaaggagagtgacattttgttctgtttaggagtccatctgattgcatgtggccccatctggttcacttcagtgagagggaagcatgactattccggggtggccttttcctctttccaggttaaacaagtgtttgtggttgctgtggagcatgtgagaatgatggaaggagttcggcagtcaccactgatgattgagcacaccctgcatgcatggtcctgtgcaggatgaagctgtccctggtcagggagctgcagaaccacagctcctgcagaatgggtgaaagctgagctcatcatatggaactgtccaaggtacaacaccagcacgtggctgcttcagcatcttatccttgaggagtaggctcttatccattgccaactgcttggtccaggctagccgtctcccgtggatcacc

SEQ ID NO: 284 - DNA, 2460 bp, Homo sapiens
atggttgctctggcctctttgggcccagctctgacgccaggctgtcttgcctctgctcacctgcagctatccagcaaacctcggcatgagcagcccgagtggctgcgcagcgaggagcatccgagccagtttttcgccgaggcccagcggctgcgggagcagagactgttgctggacgaagaggtgtcagtcgcggggcgggtatacggggtgcatcgggtgatcctggccgcaatcagcagcctcttccgagacaggctgctgggcggcggaggtccgcggccccccttcagcctcgaggtgtccccagggggctgggaggccgtgctgacctttgcctatgagggggtgctgggccccgcctcgcagggggatgtgctggccgcagcagaggcgctgggagcgccccgggtgaaggctgctgcccagcagacatgcgagagggctggaaatgccggggaagatgtaaagaagcccagccaggcagaggagctgagggagaacctgcgcggaatcgagctcctctaccgagagggcgtcgggtgtgacttgaagctggaggcaggcggctgccagctgtcgggtgagggcctgtggggcattaaattactgcaggtgcatatgctaacggaatgtaacaaggaatctccagccagctggctagagctaagggtacaatccatggcagtagaacaagcagaaagtggattgactcaagcagaaattaacaaaaggcccttcttggcatcctccattcaggacacaggaaagccaggggaacatggtggaaaactcaatgtgtgctttcaccttgtgcaccgagccgccctggcctgtggcagtgagttctttggggccatgctcctgagcgggatgagggaatcccagggcacagaggtatctctgcggacgatctccacccaggacctgcgactcctcgtctcttttgcttactccggagttgtgcgggcaaggtggccagggctactgagagctgcccaggctgctctgcagtaccagagctcttcctgcttggatttgtgtcagaaaggcttggcacggggcctcagccctgcccgttgcctggccctgttccccatggcggaagcccctgggttggagaggctctggagcaaagcccgtcactacctcctcacccacctgcctgctgtagccttgtgtcctgctttcccttctttaccagctgcctgcttggctgagctcctggatagtgatgagctccatgtgcaggaggagtttgaggcctttgtggctgcacggtgttggctggctgccaaccccgagacccaggagtcagaggccaaggccctgctgcgatgtgtccgctttggccgcatgtccaccagggagttgcggagggtgcgggcagccgggctacttccacccctgaccccagatctgttgcaccagctgatggtagaggctgatgttccaggccaagagagacggagggagcctgaccgggcactggtagtgattggcggggatgggctcagaccagacatggccctaagacaaccatcccgagcagtgtggtgggcccgggccttccgctgtggcgtgggactggtacgaactgttgagtgggggcagctgcctgccctgcctgcccccggacgcttccggcatggggctgcaagcctggcaggaagtgaactctatgtgtgtgggggacaagatttctacagtcactccaacaccctggcttcaactctcaggtgggagcccagtcaagaggactgggaggagatggctcctttgtcccaggctcgaagccttttctccttggtggcactggatggaaaactttatgccctgggtggaagacacaatgatgttgccctggactctgtggagacctacaaccctgagctcaatgtctggaggccagcacctgcacttccagcaccatgttttgcccacgcagctgcgattttggagggccagttgtacgtgagcggtggctgtggtgggactggccaatacctggcctcactgatgcactatgaccccaaacttgagaagccagggacgtttctgagccctatgggggtacctcgggctggccatgtcatggctgcattgggtgggaggttgtatgtggcaggtgggctgggtgagactgaggacctgctaagctttgaggcctatgaactaaggactgatagctggactcacctggcacccctaccctccccccatgtgggggctgcaagtgctgtgctgcagggggagctactggtgctcgggggctacagtcaccgtacttatgccctctctcaccttatccatgcctactgtcctggcctgggccgatggctctgcctgggaactctgccaaggcctcgggctgagatgcctgcctgcatcctgacactgcccgctgtgcagcacatagctttggttcccaccccacaccaaaccaaacctgctgggtga

SEQ ID NO: 285 - DNA, 1711 bp, Homo sapiens
aacaaaagcagggtagggctccagctaagccacgtaggcactacgatgggcaacagaaaggttggtttctgggcaattcagagaaaccaaggacagctacccccagaactcagagtagccaactgggctgctcacaggagatgccttaactgaaaggtgatcagactccacaggagacccagagaagatgtggagggagctcagaggctgtcctggaggagacctggagacagctcagaggctgtcccagagaagacgtggaaagagctcagaggctgtcccagagaagacgtggagagctcagaggatgtcccagagaagacgtggagagagttcagaggctgtcccggagaagacgtggaaagagctcagaaactcagagactgtcccggagaagacatggaaacagctcagaggctgtctgcaagaagacgtgcagagagttcagaggctgtcccggagaagacatggagagagctcaaaggctgtccacaagaagatgtggagagagttcagaggctgtcgttactgctgcacttggctgtttttctttggataattattgcaatcaattttagtaattcaggtgttaaatcacagtcaagcacctatttacctagtggtaaaatccttaagtaagtcatatttggttgggaagatcaaagaaatcacccagtctcccacatccgaaattgtgcagtctggactgtcaggaacaaaagtgaaagagagacgtcatcaaggccgggcgcggtggctcatgcctgtaatcccagcactttggaaggccaaggagggcggatcatgaggtcaggagttcaagaccagcctggccaatatggtgaaaccctgtctgtctctactaaaaataaaaaaattagccaggcgtggtggcgggcgcctgtaatcccagctacttgggaggctgaggcagaagaatcacttgaacctgagaggcagaggttgcaataagccaggattgtgccattgcactccagcctgggagacaaagcgagactccatctcaaaaaaaaagaatgactaaaattaagaagattgatgattccaaatattggtaaagatgtagaacaactagaactcccacatattgctgatgaaaatgaagaataatacattactttggaaaatactttggtactgatttaccatatgaccccaaaatctcacttgtagaaatttatacaggaaaaatgaaaacatatgctcacagaaagcttgtatacacatgcttatggcaataaatttatttatagttgcctatcaacaagtgatgaacaaatatattttagtatcttgatactactttctagctagaaaaggaatactactaagcaaaaatagaggatgaagtagtaatatacataacatatatgaatttaaaaacaccatgctgattgaaagaaaacaattatcaaatacacagtgtaatattctattcacagaaagtttgaaaacaaaaaactatagtctctgaaagaaaaccattggttgcaggaaggtggggattcattggccacaaaagggactgaggaagctttttatgggtaatggaaatattttatatcttgatggtggcaccaattatacaactgtatgtacacatttgtcaaaattctaatcgtattatacacaacatgagtgactttaactgtctataaattatatctcaataaaattggtcttaaaagat

SEQ ID NO: 286 - DNA, 768 bp, Homo sapiens
  misc_feature (592)..(592): n is a, c, g, or t
  misc_feature (691)..(691): n is a, c, g, or t
ggcagtgtggagggagagagcctggttcttctgccgagccctgggcagccttctggtgtcccaggatagaagaaagactcacatttctttgcaccattgagcccatcactgcagcaccagagcatctgacatctgcaaaacaacatcattagatgagacccagggcctaagttaaacaacttgcccaaagtccggcacgcttaggaggaggcacacctgacttttgactctacgtctgcctactccctgacctatgctctttctagaaagtggacacttgcccagataacaccacttctatccacttctatccctcggggaggccctaccccatttcagctgggctcagagctgggcaaattcagacctagagtggatttcaactctgccacctgccaaagggtagaccccaacatgccatgtgtttctccagtgggcatccttggtttccctggctccatgcttaggaggctgggccctccacctgacttcttcaaagccctccccaagagccagctcctgcagagccaagagccgtgagccgatcctccaaaaaccagacccataggacaagaggccaggagggagcggncagctctcggtgaacacaggtacagggccttggcaggctcagcggtcaggacgtccaggtctcatctccagtctgcctcttgctagtcacttgacctcncgcagcctcagtttccccatctggtagatgatgacgacaccctccagctcctttagtaaggggatgataaatgacag

SEQ ID NO: 287 - DNA, 1308 bp, Homo sapiens
atgccacgcataaccaatgaggagctgaaggagaaaaatgccgaactacaagaagaacttcaactggtagaaactgaaaagtctgagatccagctccacatcaaggagctaaaaaggaaactggagacggacaaaatcccgctgccacaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcagatgggggagcaggaggggcagatgggggagcaggaggagcagatgggggagcaggaggagcagatgcagaagcaggaggagcagatgggggagcaggaggagcagatgcggaagcaggaggagcagatgggggagcaggaggagcaggtgcagaagcaggaggagcaggtgcaaaagcaggaggagcagatgcggaagcaggaggagcagatgcgggagcaggaggagcagatgcgggagcaggaggagcagatgctgaagcagaaggagcagacggagcaggaggagcagacgggggagcaggaggagcagatgcgggagcaggaggagcagatgcgggagcaggaggagcagatgcgggagcaggaggagcagatgcgggagcaggaggagcagatggggaagcaggaggaacagatgtgggagcagaaggagcaaatgtgggagcagaaggagcagatgtggaagcaggaggagcaaatgggggagcaggaggagcagatgcagaagcaggaggagcaggtgcgaaagcaggaggagcagatgcggaagcaggaggagcagatgcggaagcaggaggagcagatgcggaagcaggaggagcaaatgggggagcagaaggagcaaatgggggagcagaaggagcagatgcgggagcaggaggagcaaatgggggagcagaaggagcagatgcggaagcaggaggagcacatgggggagcagaaggag

SEQ ID NO: 288 - DNA, 652 bp, Homo sapiens
ttttttttttttttttttcctgcatctcgctgaatttaattaaggatcaacctgaaataaaatggctccaacagggcagaggatgcctctgagaggttctgaggacaggagcaagagactttggtgttatttggtgttgttggtcctgacagtcagggtcaagtagaagaatatgaatcaatgaagcttgaggaaaaattagaaaattagtctagcaaggggagccccatttctgtgcagaaacatatggacacctataaccagcagctaaagatattggacttcttttaacatacagaggtgcccagaacaagtgtaagggcctcagtgagctgcaagttaacgttttgttgctttccaagtctgcttttctggaatcctgacatcccctacaaataaaatcaacattgtggactgtctcattttagccatgaaaggaatggacctaaagtctggttagtgtctgaggtggtggttgtcgaaggttccagagaggtgccaaggaaatatggctcagccgcatctccatgaggaggagtaagtccatgcttctgcccacaggggccttctaggctaccggtgagctgtcacttcctcttccaggagagtttgatgggtgctggtgcagcagccgacttaggaaccagaggag

SEQ ID NO: 289 - DNA, 2465 bp, Homo sapiens
ctcactaccctagttgggttggaggatcctctatctcccctccctacttaggttgactgctgtttcctggatcgcagctcggaagatccacctgggcgaatacaaaaacaaacgagactccccttccagaaagggaggaaggaaggagacagaaagacgaatgacactgagcgtgtaaagcccggagacagcctctctctaccccaacctaaccctcaaggtaggggatcccccgaacatcgctaccgtaattatggtagaaattcctgaaacggataactggacctcagcaccgtcatttctagcagaatgattgagctttcctctgacccaaagccaaggggttccagcaggggaaactaacgaccatccgcaaaaaccctcacccaagtggggagtggaaatcctggctcttgggttgcagagcacaacttgacgccagcgcgtttctcttcccccacgcaatggcaagtggggcgggagtcggaggggagaggaggagaggagaagagaagaggagggggaaggggaggggagaggcgaagggcggcccgggttccagcagccgccccgccctccggctcgcggcggattcggcgctgcggctggagccggcggccgggtgcctgcctgtccaggcagggtctggccgagcgtcgcgtcgccgtgcagtgcgccgggtgtccgggagatggcttcccctctctcgcccgctgctgccgctattgtctcacccggggtggcctgactctgcgagctcgcgcacgctctcggcggagagcacccctccccacccccacaagctggtccttgcgccctttgctgcctctccctctgccccttggagcctagggtctgtgcggagcctggagaggggagcggcccgggagcaggcggcgtgcggccggccagctcctctcgcgctggtgcaagaggcgcctggagccgcagagcgagcccgggaggcgcggagcgagcagcccacgtcgccaggcacaagacacgtcggatgttgcagcagagccagcagctagcgcaggtaggacacgcatcctgcgggttgcatcggccccagcgtctgtaaagtgcccccagagtggaggcagccgaggtcagggggctctccctccaacatggcaacagcggaggtgcaacaatggaagcagccgagggttcctggcggcgggctgagcggcggacgccgtgggagcctgagctcctgcccgccgggcagagcaggttgcccctcaccccactccactccactccagcagcttcagggcctctggggctccaggcacccgcgtccccacccccttctcgctaaacacacttcctggctcccagctgcagggcgatctgaaccagtcaatggctttggggtttgtttatttaagataagaaataaaaaaagcaaaacctgtcctgtgatggggttagtgccttctgtggactgggtgagaagtcggcatctagcctggggaatgtgtacgtttcttagtcgggcggagggtagaattggattctcccttataaggatactgcagcaaaaggagactgaaagcttgaaagagggagagggaccctcaggcctgagttcgccggtgctgggagaaggcgctgctctcctggcctatacttgtccctcattttcagctcccgacagcggtgactttgatgttggaggagcaatcgcagcaggaagcacaagcaaggctgccaagctggtgtggggtggagtagggtggggagcccaggggcttggcaggcttctggattgtgggaagaggttaccaaatgtatgaggttagtgcacacaccctagttggctgatgttgaagtgtgtgtgtgtgtgtgtgtgtgtgtgtgttttctgccattgctcttgctccttcaggcctgccttttctcctctccacccgcttctggggtcttcgtagcttccctgccccagcccttccaatcatgcctgggatggaatcgctgtattgtctctggcagctctcttgggctgttttttctcaactctgttggagagttttgtaccctgggctggctggtcccagcatggcaccagattctttagcaggcggctacccgggctccaagaagtgggccaatgctgcccctcctccttgctctaaactacctatttgggatatggccaggcagatgtaagcaatttgtactaaattccaaccctgaatcagtgctgaatgaaaacttactctgttgctgcatcaggctttgggaagatattaggaagagaaatggcccaggaggtggcaatgccgacccccaaatacttccctctccccaactccagctgccgatcccagagcagacaggcagtgagactttggaatcccagctcctccagagtctggctggcccatcttgaggttgtgtccatggaaaaattaagtcgaggcacattttatagctctgcttggcagccagcatct

SEQ ID NO: 290 - DNA, 553 bp, Homo sapiens
  misc_feature (417)..(417): n is a, c, g, or t
  misc_feature (423)..(423): n is a, c, g, or t
  misc_feature (532)..(532): n is a, c, g, or t
gccggatcaaatatttataacgcactgtgcgcggcgttgggctgctacagttcagcaaagccattaataataaagtggatggaaatgcacgagttaccgacatgcctagcaaagccatttataatgaaatgtaaaatttggctgtgggaagcagcccaccagccccagccgcagcaccggccaggatctcctggaggctggggaaggagcggtgtcgtgaattatttgtgaggtgttcagacgagaatgtatactccccatagcacaccatataaatatgctattaatatacccaaggtggcatgcattattcatggagcctaattaattaatgggtggccccttaaaatggggtgtcacagcttccagctccctgtcctgccgggggcagtagggatggcaattggttgatggcancttggnggtggggggagggcaacgtcccttccacgctctgcagggggctgaccgtggtgccccacaaccgtcacagggttcctggggcaaaatcaatttgggaacacgggcacantgtgtcctctcctgaaaagag

SEQ ID NO: 291 - DNA, 3375 bp, Homo sapiens
atggacctgggccccggggacgcggcaggagggggaccgctcgcgccccggccccgccgccgccgctccctgcgccgcctgttcagccgcttcctgctggcgctgggcagccgctcacgccccggggactcaccgccccggccccagccgggacactgtgatggcgacggtgaggggggcttcgcctgcgccccgggcccagttccagcggcccccgggagccccggggaggaacgcccgcccggaccccagccccagctccagctccccgccggcgatggggcgcggccgccgggcgctcagggcttgaagaaccacggcaacacctgtttcatgaacgcggtggtgcagtgtctcagcaacaccgacctgctggccgagttcctggcgctggggcgctaccgggcggctccgggccgcgccgaggtcaccgagcagctggcggcgctggtgcgcgcgctctggactcgcgaatacacgccccaactttccgcggagttctttcagaatgcagtttccaagtacggctctcagttccaaggcaattcccagcacgacgccctggaattcctgctctggttgctggatcgtgtacatgaggacctggagggttcatcccgagggccggtgtcggagcagcttccgcctgaagccactaaaacctctgagaactgcctgtcaccatcagctcagcttcctctaggtcaaagctttgtgcaaagccactttcaagcacaatatagatcttccttgacttgtccccactgcctgaaacagagcaacacctttgatcctttcctgtgtgtgtccctacctatccccttgcgccagacgaggttcttgagtgtcaccttggtcttcccctctaagagccagcggttcctgcgggttggcctggccgtgccgatcctcagcacagtggcagccctgaggaagatggttgcagaggaaggaggcgtccctgcagatgaggtgatcttggttgaactgtatcccagtggattccagcggtctttctttgatgaagaggacctgaataccatcgcagagggagataatgtgtatgcctttcaagttcctccctcacccagccaggggactctctcagctcatccactgggtctgtcggcctccccacgcctggcagcccgtgagggccagcgattctccctctctctccacagtgagagcaaggtgctaatcctcttctgtaacttggtggggtcagggcagcaggctagcaggtttgggccacccttcctgataagggaagacagagctgtttcctgggcccagctccagcagtctatcctcagcaaggtccgccatcttatgaagagtgaggcccctgtacagaacctggggtctctgttctccatccgtgttgtgggactctctgtggcctgcagctatttgtctccgaaggacagtcggcccctctgtcactgggcagttgacagggttttgcatctcaggaggccaggaggccctccacatgtcaagctggcggtggagtgggatagctctgtcaaggagcggctgttcgggagcctccaggaggagcgagcgcaggatgccgacagtgtgtggcagcagcagcaggcgcatcagcagcacagctgtaccttggatgaatgttttcagttctacaccaaggaggagcagctggcccaggatgacgcctggaagtgtcctcactgccaagtcctgcagcaggggatggtgaagctgagtttgtggacgctgcctgacatcctcatcatccacctcaaaaggttctgccaggtgggcgagagaagaaacaagctctccacgctggtgaagtttccgctctctggactcaacatggctccccatgtggcccagagaagcaccagccctgaggcaggactgggcccctggccttcctggaagcagccggactgcctgcccaccagttacccgctggacttcctgtacgacctgtatgccgtctgcaaccaccatggcaacctgcaaggtgggcattacacagcctactgccggaactctctggatggccagtggtacagttatgatgacagcacggtggaaccgcttcgagaagatgaggtcaacaccagaggggcttatatcctgttctatcagaagcggaacagcatccctccctggtcagccagcagctccatgagaggctctaccagctcctccctgtctgatcactggctcttacggctcgggagccacgctggcagcacaaggggaagcctgctgtcctggagctctgccccctgcccctccctgccccaggttcctgactctcccatcttcaccaacagcctctgcaatcaggaaaagggagggttggagcccaggcgtttggtacggggcgtgaaaggcagaagcattagcatgaaggcacccaccacttcccgagccaagcagggaccattcaagaccatgcctctgcggtggtcctttggatccaaggagaaaccaccaggtgcctccgtcgagttggtggagtacttggaatccagacgaagacctcggtccacgagccagtccattgtgtcgctgttgacgggcactgcgggtgaggatgagaagtcagcatcgccgaggtccaacgtcgcccttcctgctaacagcgaagatggtgggcgggccattgaaagaggtccagccggggtgccctgtccctcggctcaacccaaccactgtctggcccctggaaactcagatggtccaaacacagcaaggaaactcaaggaaaatgcagggcaggacatcaagcttcccagaaagtttgacctgcctctcactgtgatgccttcagtggagcatgagaaaccagctcgaccggagggccagaaggccatgaactggaaggagagcttccagatgggaagcaaaagcagcccaccctccccctatatgggattctctggaaacagcaaagacagtcgccgaggcacctctgagctagacagacccctgcaggggacactcacccttctgaggtccgtgtttcggaagaaggagaacaggaggaatgagagggcagaggtctctccacaggtgccccccgtctccctggtgagtggcgggctgagccctgccatggacgggcaggctccaggctcacctcctgccctcaggatcccagagggcctggccaggggcctgggcagccggctcgagagggatgtctggtcagcccccagctctctccgcctccctcgtaaagccagcagggccccgagaggcagtgcactgggcatgtcacaaaggactgttccaggggagcaggcttcttatggcacctttcagagagtcaaatatcacactctttctttaggtcgaaagaaaaccttaccggagtccagcttttga

SEQ ID NO: 292 - DNA, 2852 bp, Homo sapiens
gcggagcgcgggaggccagttgggaggcgcacatccggcggttacccggtgcttcataaagccgctttcgccgctggctgtcgccgcgttttgcctccgcagcagctctgggctcttctcagctgcgcgagcagctgctccaatgccccggagtggccatgggcgccccgcactggtgggaccagctgcaggctggtagctcggaggtggactggtgcgaggacaactacaccatcgtgcctgctatcgccgagttctacaacacgatcagcaatgtcttatttttcattttaccgcccatctgcatgtgcttgtttcgtcagtatgcaacatgcttcaacagtggcatctacttaatctggactcttttggttgtagtgggaattggatccgtctacttccatgcaacccttagtttcttgggtcagatgcttgatgaacttgcagtcctttgggttctgatgtgtgctttggccatgtggttccccagaaggtatctaccaaagatctttcggaatgaccggggtaggttcaaggtggtggtcagtgtcctgtctgcggttacgacgtgcctggcatttgtcaagcctgccatcaacaacatctctctgatgaccctgggagttccttgcactgcactgctcatcgcagagctaaagaggtgtgacaacatgcgtgtgtttaagctgggcctcttctcgggcctctggtggaccctggccctgttctgctggatcagtgaccgagctttctgcgagctgctgtcatccttcaacttcccctacctgcactgcatgtggcacatcctcatctgccttgctgcctacctgggctgtgtatgctttgcctactttgatgctgcctcagagattcctgagcaaggccctgtcatcaagttctggcccaatgagaaatgggccttcattggtgtcccctatgtgtccctcctgtgtgccaacaagaaatcatcagtcaagatcacgtgatggcaagatggtggctggcttctctgcttatcgcccctcatgcagtgggcttcctttgctaggaagacagccaagggagttcgaatagttggggtgtgggctatcttttcaaaaatctatttgctggggctcttaatttctttagtgttctttgtatgtagggatttaaactttgtcatatggtacaaatattccctgcccccctgcagtttcccatttgtctttcagtatgttaatatttttgtgccatactggttttaaactttcatgttgtcacatctgttaatcttttctttaggatttctggattttgtgtaatttttaaaaaggtcccctcctcctccctaatgtgtctgtggaccacctggattccactgtacaaggggaaaagtgtctattcctttcccaaagatggaaaatggagggcttagggacactagatgcatctttctcagcatcacttccagatgcagtgacttgttgggctgcgtccttaatggccatggcagagcagtcccttgggggatccagccctgtacaatgcatctcttcctggagaaagctggcctgctccagaccccaccattcccaggcgcccttggagtggactctactgatgacagacagaccctctgagagacaagaccctctgactctgtgatggaagatgccagagattttcctttggggtaattgtccttaaacaaaaccaaacagatgaaacacacacaggacttgtggctaaaaaggctagtttttcacttgcatttctcaactaacccaggttttacatgcatctgtgaatccttttactactacctctgtggagagatggagagacttcagataaacgtgaagctaatgagtaaaaccctctctgccaaaacctacactccactttaggcccttcttgaagatgagcacaatttttaaatactgagcacaatttttaaatactgacatcacttcctcttccccctcccaccccagctcagcagcctcaaatctacagagaagaagaattatggcatgaacattcccacagacccaccatctttaagacttgacctctgtaagtttaccaaagggctcctcacaattgtggtgggggttctggttcaaaatttggagcaaacatgaagtttttggaaacgttttctcatttgaagcctccagtatgctgtactattctggaaattaccttcaagagtctcacttcttgtttctgttgtgttttctgtgggcatcatgttcttcacgcttgcagtagaaggtgctttctcggtttcccagagtatccaacggctcacctttctcaagtgctggcagtagctatgcactcacgggctggtttgggtcgctggtgcagcagcgcaaatctgttgccttctgaatttttctcacctaatgtgacactggctacaatgaatcttctcttcatcgggctgaatgaaagattcaagaaccatcttcaaggtgcatggtgggaattatcaacctcagggatactcattttaactcaggcgtgtcctgctttgtaacattccattgttgggagagggcaggacaggtgtgttcttctgtgggcaggagtcatgtcactgtcctacatatgtaagagttgggaaggtgacgatttttgacacatccaggaactcttactctagttagaatttgtaccagatccaaggtgaaaaccccaataagcaactgaatttagagtttaaaaatgaatgactttatgctacatctgtggttatcaaattatataggttgttgagaagcagaacgctgtttgtagtaagaaatctttgtggaaccccagtgtgtgaagtaaattgtatgttattaaatttatttaaggtt

SEQ ID NO: 293 - DNA, 621 bp, Homo sapiens
aaaatatatataaaaaaaatttctaagtgatgaatgcttagggtattgctgcttatttcttactgtactgtggtgtcaacatttctaagtgtccataggacttctttgggcctgaatatattatcagtttttataaaagcatttgtgtaatctcaaaatgtgtttttattctaccagttctatttgttaactcaattttttcattattttattcaaatccatattttctctgactttcatttactttagagttcttaatctgggggtccatggcctgcctaggagtctttagcatgtaggggtttaggagttgcagacccctagggatcgaacaaagctgggtatgtgcttgaaggaattttgctgggacaaggatctgtagtatttactatatttttaaatgcctctgtgacaccaaagcagttcagaacactcatttacctgatctaatcatagtttgatgtttgtgtgttatatctctatgtattcctgtttcacttttaatttctgtatgtgtattgtcgctatgttgtgcagtttttctcaagtcatttttgagaaataggcagggtatgaattatcaataaataagtatcatgtttggggcatataaaaaaaaaa

SEQ ID NO: 294 - DNA, 614 bp, Homo sapiens
ggacctgggaaggagcataggacagggcaaggcgggataaggaggggcaccacagcccttaaggcacgagggaacctcactgcgcatgctcctttggtgcccacctcagtgcgcatgttcactgggcgtcttcccatcggccccttcgccagtgtggggaacgcggcggagctgtgagccggcgactcgggtccctgaggtctggattctttctccgctactgagacacggcggacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcaccaaa

SEQ ID NO: 295 - DNA, 554 bp, Homo sapiens
gtcttccatgggctgaaaacatctattaaatggggactttgatcctaaagaaaaaacgacaaaagaatgttgctcgacctcacctctatcaactttcctctgtttcacctggaatgtgtaactcagctgtccacatcttggaccacttgaccatgctgtgtgatcctaaggacataacccaaaaggcaatctccaaactcacggtgtcgtcaccaattcaacatttctattttaatgtgggatcaacttgtcatggtcacaatgctgattatgacttccatccagttttccttctatacatgtccaaacatgtcaccaacatgaccccattgactcgggacttgtcaggggtgagatatgaaaggattcagatctgttttgttcctgcgtggggtcccagaactacttccagcagcaagacagttaagagacacattggatgaggcaacagcggggaagaaagggagctgatcttgaattggctgtgtactgacagattgtatgaatgaaagcaataaaaataagccccaaaatctgggttttgagtggaaaaa

SEQ ID NO: 296 - DNA, 419 bp, Homo sapiens
cttaatgtattgctttatttctcttcttttgacttatgcacgcaaacatagcccttgacatatttaatgtgaaaaatgatttagaatggtgaggataggtattttgacaccattgccaatttgtgactctgatatgttaatttgattcgaatatgtaaacttagcacgtgtctgaagaaatagtgagatgggggatattgattaggcttccttgaataaattctgctagggataccccataccaatccttgtgtctcttattttaatgactgagcaaaagtcatgactcttctctcatatttactggaggaatctgatccagttaacagtggctgatatttcaaagtcatttgtatttccttatgagtcttggagaaggagcaagcatggtgtctttaggggtgaaaaagaccaactta

SEQ ID NO: 297 - DNA, 274 bp, Homo sapiens
tttttttttttattcccccatgatctttccttcttccctaatatacattagccttcctacgttacagcctgtattcttcttcttcctgtgatctctagagtaactgatgttcagaccttcaatcttttaggagcttgaaaatgtacaaatcttttctctctcaacaaaccttgcctctcaaaagcccactttgacaagagtcctaaatgcatttgtgcaatacatagcttgttctgagattactttgaacactgcaactcttcagttcattagg

SEQ ID NO: 298 - DNA, 526 bp, Homo sapiens
  misc_feature (366)..(366): n is a, c, g, or t
ttttttttttttttttccttttcatcctgcatattatagttccatcctggatcatttttcttctaccagaataactgtcttttattattcttttaacgcaggcctgttggcaacaaatgccctcagttctcatttgcttcaaaatgtttttatttcactatattttttgaagcatattttactgagttaagattctagattgtgtcttacttttctttcatcatttcaaagttgttattaaattacttccagctttcatcatttctgttgagaagtcagctgtcatttctattgttgttttttggaaggtaatgtgtctttttttttgcttctggatgcttttaagattttctcttcacttttcancagttttactaggatttgcctgcttgtggttttgcttgtgtttctcttgcttgaggttctgagttttttaaacatggggatcgatattcataagttttgaaaaatactaatttggtatttctaaaatattgattttgtcttatgtttctcttctctttct

SEQ ID NO: 299 - DNA, 2673 bp, Homo sapiens
ctccgagcaggacactgctacttaacaaggtggtttgagccaagtatgtgtcttgcgggtctttgcgaaagtgaaccagttattaggggcgcctaacgacctggggggtcaactaaggggactgtggcacgtttcaggcaggattcctccttcattcaaactgcatcacccaggagtctgcaaattccccaaagtaggaggaaaaatgaccacattcaaggaggcagtgaccttcaaggatgtggctgtggtcttcactgaggaggagctggggctgctggaccctgcccagaggaagctgtaccgagatgtgatgctggagaacttcaggaacctgctctcagtggggcatcaaccgttccaccaagatacttgccacttcctaagggaagaaaagttttggatgatggggacagcaacccaaagagaagggaattcaggaggcaagatccaaactgagttggagtctgttccagaagcaggagcacatgaagagtggtcctgccagcaaatctgggaacaaattgcaaaagacttaaccaggtctcaggactctatcataaataactctcagttctttgaaaatggtgatgtcccctcccaggttgaagcaggactacccacaattcatacaggacagaaaccttcccagggtgggaagtgtaaacagtccatcagtgatgttcccatctttgatcttcctcagcagttatactcagaagagaagtcttatacatgtgatgagtgtggaaaaagcatctgttacatctcagctcttcatgttcatcagagagtccacgtgggagagaaactctttatgtgtgatgtgtgtggcaaggaatttagtcaaagctcacatctgcaaactcatcagagagtccacactggagagaaaccattcaaatgtgagcaatgtgggaaaggtttcagtcgtagatcagcacttaatgttcatcgtaaattacacacaggagagaaaccttacatttgtgaggcatgtgggaaggccttcattcatgattcccagcttaaggaacataagagaatccatactggggagaaaccattcaaatgtgatatatgtggtaagaccttctattttaggtcaagacttaagagccattccatggttcacacaggagaaaaaccatttaggtgtgatacatgtgataagagctttcatcagagatcagcacttaataggcattgcatggtccacacaggagagaaaccgtacagatgtgagcagtgtggaaaaggctttattggtaggctagatttttataagcatcaggtggtccacacaggagaaaaaccatataattgtaaagaatgtgggaagagcttcagatggtcctcatgccttttgaaccatcagcgagtccacagtggagaaaaaagcttcaaatgtgaagaatgtggaaagggattttatacaaattcacaactgtcttcccatcagagatcccacagtggtgaaaagccatataaatgtgaggagtgtgggaagggctatgttactaagtttaatcttgacttgcaccagagggtccacacgggagagagaccttataattgtaaggaatgtgggaagaactttagccgggcctcaagtattttgaatcataagagactccactgccagaaaaaaccattcaaatgtgaggactgtggaaagaggcttgtacacaggacataccgtaaagaccagccgagagactatagtggggaaaacccatccaaatgtgaggattgtgggagacgctacaagaggcgcttgaatctggatatacttttatcattatttctaaatgacacataattgttcatatttatggggtacaacgtgctattttaatgtgtgcatacaatttatagtgatccaatcagtgtaattggtgtatctgttacctcaaacatttaccatttctttgtgttggaaaattcaaaatccatttgagaggagttggtagacagcaagggaagggtccctggagacccccagccaaacgggtcagtgtctcatccccacataacacaaaaagcagcctggggaagacaatcaagctacaggcactgataagggaactagcacaggggattgtgcctggagacatgcccatggctgcacagatagaagaacctccagcccattcaggtaaaaactcgcacaaacctccggctcactcagttaagggaacaagaccagacacagaaatgcctttgtcctttgtataatcagcaggctccgaggaaaaagtttcttcttttgtgggcatgaacacagtgggcttcagtaggttcaggttggcactttcttttgtggaaaaggaaaagcccagcctctgtaaatcatcacttcagctcctgattggtcccaggccaagctgaatagcccttaggaataatcacttcaactcctgattggtcccgggccaagctgaatagcccttatgaatcatcacttcggttcctgattggtcccgggccaaggtcccagaccaagctgaatcacgctttctccaagacagcccgcaggctaagtgcattccttccccttcccagtccataaaaaccccggaccccagcctcatactgggcaacttatttggatccccatctccactgtggagagcttttttctttcacttattaaacttttactccaatttc

SEQ ID NO: 300 - DNA, 444 bp, Homo sapiens
tttttttttttttttttggaggacgggctgacgacaggactggcccgggtcagggaatgggtggctgggattggaagtgaaccagtgccttgtcctggcggagccactggagcccactctgctcctgtgagcctgccactcggagaagttagagggcagcaactgcttcggcccgcgtccttcccccaaggccaacagctgcagaatttctgccccagccgcccccacccccggaggtgtctgcacagtgtccaggtgtcgggcccaggaagcccttggtggatgctggtgaagaagggacaggtacagggtatgggagtgtgtccggaggtcctggggtggtggctgtgcatgggtccgtcgtcctgggggaggaggcactgtgccctctgatggccaggtggacagagtcacgactgctttggtgggtgtccccggggctca

SEQ ID NO: 301 - DNA, 475 bp, Homo sapiens
ttttttgcagcaccgtaattaagtttattatgcacgtgaatgcgagtggaagaatgcctctgaaaagaggcaatgagaaaatcaaacattgtctattgaacacaattagaataaagttaatcaagtgccctgatgatagccagatgtattaccccctttatagtcttaggatgtttttacctaaagaaacagtgagagaggaggcaattagaggctggctaggtagatagagaaggaggttcttgggagagagacagcgccggtgggaccgcacctgtaccctccctatggtgtaactagcagatggaaatgtagttaagaatttcctctcataccaggatgtctgctcagaagggactgtcccaacttaggcacaggcaccataaatcaactaaatgtcctgaacatgacccagagctaattgtaatatcattagcactgtggtttgggcgcctcccccccaccatggtttcgc

SEQ ID NO: 302 - DNA, 1124 bp, Homo sapiens
acaagagctaggacaggaggagccgcagagctcgtaattgctgcggggaggacaggccagctctggaagaaaacagacagggtcttgctctgttgcccaggccaagtgcaatggcatgatctcagctcactgcagcctcccgattgttccgatgaaacttttaaccacgtggtttgttatgcatgtcacacccacaggccacttcaaacttgcagcacacagtgagcaactcggacaatatagggtccagtgctgggaggtggacctgggtcccattaacctggacagacacctccaagatgagcatgagggggctgctggatctgttctcctttcacagctgtatcctgaagaatggcagtgagccggaagagccacaggattcggcaaagacggacacacagctgagtccggctaccctggcgttggagcgcgaggagcacagcagccgccacgtcccttccgtcttgtcaaagaccatgagccgagcgtccgcagagctgacctgcactgcagggcgacagggcccggggccgcctgggtcccacagccaggctccccacatgcttccccagccggagcccctcctggcctgtgctccagccatgtggtgtagacgtgaaccccagcccatcggagggttgcagcccccacatctgcgattgcatctggaatcatgactcaaggactttttttttttaaagacagggtctcgctctgttgcccaggctggagtgtagtggtgtgatcttggctcactgtagccttgacctcccagactcaagaaatcctcctacctcaacctcctgagtagctaggaccacaggcgtgcaccaccacacctgactaatttttttgtttgtttgttttgttttgttttgttttgtagagacgggtcttgctatgttgcccaggctggtcttgaactcctaggctcaagcaatcttcctgcctctgcctcctaaaatgctgggattacaggtgggattacagagcaccatggcactctgccagactcaaggactcaggtcggaccaatcaacagcagccttgaggctgtggccggcccctccgcgaaccaggggaacttcactctccattagaagtcctaagttggctgctca

SEQ ID NO: 303 - DNA, 468 bp, Homo sapiens
tttttttttttgtcttcaaatatggagaaattacactttaattggattaccatcttcatagggattagtacatttctttgattctaaaatgcatttttaccccacatttttaacacttggaaaactgttattaaattgatgattcatttgaaaagagatgacatcttaaaataaaataccataccatagcttctttagttaatttctaattttgactctgaatgaaattgtgtaaccacaagatcatggtggtagtgacaggagaggaggaggtgtgaggagcgtgtgggcagattcttgaaatgagagagggattgtgctacagaaaattttgcctgcttattttttatctgggattatggttctctctgacctccattcagctgcttgtaactgggcatttctcccccaactttactggagaattttggatctttttcatcattacaatcagccatttgtttattg

SEQ ID NO: 304 - DNA, 1086 bp, Homo sapiens
agtggcatcattgcactgtgactgtgcaggtcccaaacagtatggacatgaatgtcctcaagctgcatgttagcagggcttctaattccatctgcaagtgatagtgtgtggagcttagttgcacagagcgcatgttactggaggagatatgggtctgtgtcatcctgcatgggaatgatcctaaaaacaaagtgatcagtgactgctcaggactgtggaaaggtcacttggagcagtgggaaaaggtctggcagaggaataagaagatacaggtcttagaacaagccctgggacttcaaccaagtcatttaacatctggggccttcgtttatttatcctcccagcagataaagcaatacctgccctgtcttcctaaccttggaggggtcaaaaaagtgatgggtgtgaaagcattttgtaaactgtagtgcaagcatacggcaggggagtgaaccatactttcactagcgacttgaatgaggtgataaagaaaaggctcagaacttcagaaaatgcaagaggggcttgaccctggattggcagaggaaagcaatggtgggatcgataccttggagagccaaggaccaaggggttaagggtccatgaggacaggcctggatcatcaggaagctgagtgtggattccaagagtctcaaggttagagaagtcgcctagtccacctcccctctctgcttctcacagaagggtctgctgaacactctggtgacagagaactcacccaacatgttccatggcagaggcttttcattagatcaaggtgacatctgttttactggagcttccaaccacgtgtcccaatactgcccttagtcacaggcatccaggtcctctctctcaggacagcactttgaataaatgaggacagctcccatccccctttctcccagttgactttccagaaacatctcatattgttgttggctttccaccatttttcctcttcacttcctgggcctactactacactgtgtgtcctccacttggtctcttcctgaaagcaacactgtgcacaatgttcctgggggcagacttattaaaccaagtggaccacttccttcaaaaaaa

SEQ ID NO: 305 - DNA, 2718 bp, Homo sapiens
gaacaaagggagccgacagctccacaacactcagcccatggggactgcagcaggtgagtctccacccagcctccctcctttggaccaacacgaactccggagacgtctgggtgcagctgcctcaggccctgctgtcttcaacggggactgaggttgcagtttagctggctttcctgttcctgcttccccgggtccccctcaaagaagccgcctgcaccccgtgccacctcactctggcatagccctacttctccaaaccaccaggcctgccctcccttgtccacgcagatctgacaatctccacagtgctgtgcagacttcagctccaagaagttgcaagtgatggagataaaatcccttcctgagagagtcatgaaccgtggcctgtttgaggtcaaaagaagaaatgagaacaaagccaagccaaggcttcggagtgagccctgagacacctctcagctggccgggtggccagagatccaccctgcaggagccgccccgaggcaggtgggccacatctcccaacaagcggcacacaagaaggcccctcgcaagaggaggcatctgtggtcttcccagagcaaaggcagcagccccgggagcccagccagtcactggccacctgcacgcctctacacagcagacctggccaggcgggcagtgcccctggccccttgcgaatagaacgttgtggaacaggcggaacctgggcagctgtcctgcactctggccagccagtccgtggatgctcctgccaggcaggactgagccactgccagtctggccggtgccagccttttctcagatccagccacgccctctctggatacggtctggacaccggcagaccaagcaggcagttgcctccctggctggctctgacctcctgcagcacaaggagaggatgcactgcactgccaggcctctgggcaccgagggccgctgctccgccgtttctttctgctaccgctaattcaaaacagggcagggagcagctaggcagcagctgggagagctgcgggctcctccacccggttgctggtgggctccatccggccgcaccgcccgcacctgctcacctccagctgcctcggccccagcggcacggacggactcaacggcgaccaccgcggcagctccccggggactcctcgcaggtcagctgagctttgctttcagtcggcgtgcacggttcccaaacgtcggtggtgatttttgtaagtgaggtgggggtcaccacaggaagagaggggaggcaaacctcccttcccgctgtgtcccgcctttcctcctggcggttgcgtttccacgtgtcctgcctgctgcccgccccagcccacactgagcaggaaggtggggcgtggcggggaggggagtggaactgagggaagcagagagggtggtgccattgcccccggcctagcttctgtttgatcattagtttcaattcaagaaaacgttcttttgagggaattttaaaaatgaatcacgtgcacctcttaagaaaaccgagtgtcacaatcgttgttaccacgcaggtgagaggagaggagggaggacgggaaagggaaggggcatgagaaaggcggatgggactgagcttctacggctccctggccgcggcgcacgcgctggccctccccgtccacagcagcagcggcatcctccccaccctacagcgaggaggtggacgttgccccgaggggaggagcgtgtcagggtggcttccaggtgcaggttctcgcgcaggcctcagccttcataggtgcattccgctctagaacattcctgttcatgcgtggtcgtcgctcactggtggccgcttaggtgcacttctcaatggcagtgcccagcacggagcaatgcctcggagtggcagtttcttcagtacggtccccacggcctctcccaaggcggaggatgctgccgccaaggaaactggctcaccacggacgctggtgagctatggagctatcagtgaggtgtggatttctcaggcctctggcgggagccggagtaaaggccctgagtgtctagaccagccagagtgtctgcgtgtaggtcagcaaatgtgggcaaatgtctaggcggtggtgtcctgcagggagccgaaggcccgtgggggacgtgaccaactcagcattccgctggaggctacaaacagcaaactgtttatcatgaatgcaggatgtgggcaaactcacactgccctgccaccaaaaggtttgctaacagacatcactccctagctccgggctccttaaagttatctgcctaaaaaatctagtgcctattgtccaaaaaatgcaagactactgtgaaccaaacggcagactgacaatcacccccctcccccagctttctcgctatctctttttgcctaataaatacggagggctgtgtaaagctcagggcccttgtccactaaaggcaaggtgcccctaaccccttcttccaaatatactctgttgtctcttgtcttttattcccgtgttgcccgcctttgttcagtccagtaggtccccaacaatgtcctgagggtatgaatcctgaaagactactctccatgaagcaggtatttaccaggttagtgcatgtttcctgggtattaagggaaaacagtaaaatgttctgtacgggggtcccggttctgtgtcgcacgagaagagtgtgtgtctttttacttttttaatatggctcaataaaattttaaatcac

SEQ ID NO: 306 - DNA, 3060 bp, Homo sapiens
gagccagcgaggagtgaagctgagcctggcctcacacgctcctagaggaccacctcctgagagagttctttcaccccctcttctttctccaagctcccctcctgctctccctccctgcccaatacaatgcattcttgagtggcagcgtctggactccaggcagccccagagaaccgaagcaagccaaagagaggactggagccaagatactggtgggggagattggatgcctggctttctttgaggacatctttggagcgagggtggctttggggtgggggcttgtgctgcagggaatacagccaggccccaagatggacacttctgggcacttccatgactcgggggtgggggacttggatgaagaccccaagtgcccctgtccatcctctggggatgagcagcagcagcagcagcagcagcaacagcagcagcagccaccaccgccagcgccaccagcagccccccagcagcccctgggaccctcgctgcagcctcagcctccgcagcttcagcagcagcagcagcagcagcagcagcagcagcagcagcagccaccgcatcccctgtctcagctcgcccaactccagagccagcccgtccaccctggcctgctgcactcctctcccaccgctttcagggcccccccttcgtccaactccaccgccatcctccacccttcctccaggcaaggcagccagctcaatctcaatgaccacttgcttggccactctccaagttccacagctacaagtgggcctggcggaggcagccggcaccgacaggccagccccctggtgcaccggcgggacagcaaccccttcacggagatcgccatgagctcctgcaagtatagcggtggggtcatgaagcccctcagccgcctcagcgcctcccggaggaacctcatcgaggccgagactgagggccaacccctccagcttttcagccctagcaaccccccggagatcgtcatctcctcccgggaggacaaccatgcccaccagaccctgctccatcaccctaatgccacccacaaccaccagcatgccggcaccaccgccagcagcaccaccttccccaaagccaacaagcggaaaaaccaaaacattggctataagctgggacacaggagggccctgtttgaaaagagaaagcgactgagtgactatgctctgatttttgggatgtttggaattgttgttatggtgatagagaccgagctctcttggggtttgtactcaaaggactccatgttttcgttggccctgaaatgccttatcagtctgtccaccatcatccttttgggcttgatcatcgcctaccacacacgtgaagtccagctcttcgtgatcgacaatggcgcggatgactggcggatagccatgacctacgagcgcatcctgtacatcagcctggagatgctggtgtgcgccatccaccccattcctggcgagtacaagttcttctggacggcacgcctggccttctcctacacaccctcccgggcggaggccgatgtggacatcatcctgtctatccccatgttcctgcgcctgtacctgatcgcccgagtcatgctgctgcacagcaagctcttcaccgatgcctcgtcccgcagcatcggggccctcaacaagatcaacttcaacacccgctttgtcatgaagacgctcatgaccatctgccctggcactgtgctgctcgtgttcagcatctctctgtggatcattgctgcctggaccgtccgtgtctgtgaaaggtaccatgaccagcaggacgtaactagtaactttctgggtgccatgtggctcatctccatcacattcctttccattggttatggggacatggtgccccacacatactgtgggaaaggtgtctgtctcctcactggcatcatgggtgcaggctgcactgcccttgtggtggccgtggtggcccgaaagctggaactcaccaaagcggagaagcacgttcataacttcatgatggacactcagctcaccaagcggatcaagaatgctgcagccaatgtccttcgggaaacatggttaatctataaacacacaaagctgctaaagaagattgaccatgccaaagtgaggaaacaccagaggaagttcctccaagctatccaccagttgaggagcgtcaagatggaacagaggaagctgagtgaccaagccaacactctggtggacctttccaagatgcagaatgtcatgtatgacttaatcacagaactcaatgaccggagcgaagacctggagaagcagattggcagcctggagtcgaagctggagcatctcaccgccagcttcaactccctgccgctgctcatcgccgacaccctgcgccagcagcagcagcagctcctgtctgccatcatcgaggcccggggtgtcagcgtggcagtgggcaccacccacaccccaatctccgatagccccattggggtcagctccacctccttcccgaccccgtacacaagttcaagcagttgctaaataaatctccccactccagaagcattacccataggtcttaagatgcaaatcaactctctcctggtcgctttgccatcaagaaacattcagaccagggaacggaaagaagagagaccgagctaattaactaactcatgttcattcagcgtgcttggtccgacatgccttgaaaccagaaatctaatctctgtttaggtgcctctacttgggagcgggaagaggagatgacaggaagcgacgcctctggcagggcccttgctgcagagttggtggagaacagaaatccacgctcaatctcaggtcttcacgcggggggtgggggtcagatgcactgaagtagccaacagcgaagccagtccagaagaggggtccgctgggagggagggttgtgtcaggcttgggggatgggctcttcgccatgggggtctttgaacacacctctctcctttccttttgtctacggaagcctctgggtgacaaaagtaaaagagagctgcccacaacttgccaaaacagatatactcgaatcagactgaaaaaaaaaaaaaaa

SEQ ID NO: 307 - DNA, 2544 bp, Homo sapiens
gggtagctgcctgctcagaacccacaaagcctgcccctcatcccaggcagagagcaacccagctctttccccagacactgagagctggtggtgcctgctgtcccagggagagttgcatcgccctccacagagcaggcttgcatctgactgacccaccatgacacccacagacttcacaagccctattcctaacatggctgatgactatggctctgaatccacatcttccatggaagactacgttaacttcaacttcactgacttctactgtgagaaaaacaatgtcaggcagtttgcgagccatttcctcccacccttgtactggctcgtgttcatcgtgggtgccttgggcaacagtcttgttatccttgtctactggtactgcacaagagtgaagaccatgaccgacatgttccttttgaatttggcaattgctgacctcctctttcttgtcactcttcccttctgggccattgctgctgctgaccagtggaagttccagaccttcatgtgcaaggtggtcaacagcatgtacaagatgaacttctacagctgtgtgttgctgatcatgtgcatcagcgtggacaggtacattgccattgcccaggccatgagagcacatacttggagggagaaaaggcttttgtacagcaaaatggtttgctttaccatctgggtattggcagctgctctctgcatcccagaaatcttatacagccaaatcaaggaggaatccggcattgctatctgcaccatggtttaccctagcgatgagagcaccaaactgaagtcagctgtcttgaccctgaaggtcattctggggttcttccttcccttcgtggtcatggcttgctgctataccatcatcattcacaccctgatacaagccaagaagtcttccaagcacaaagccctaaaagtgaccatcactgtcctgaccgtctttgtcttgtctcagtttccctacaactgcattttgttggtgcagaccattgacgcctatgccatgttcatctccaactgtgccgtttccaccaacattgacatctgcttccaggtcacccagaccatcgccttcttccacagttgcctgaaccctgttctctatgtttttgtgggtgagagattccgccgggatctcgtgaaaaccctgaagaacttgggttgcatcagccaggcccagtgggtttcatttacaaggagagagggaagcttgaagctgtcgtctatgttgctggagacaacctcaggagcactctccctctgaggggtcttctctgaggtgcatggttcttttggaagaaatgagaaatacagaaacagtttccccactgatgggaccagagagagtgaaagagaaaagaaaactcagaaagggatgaatctgaactatatgattacttgtagtcagaatttgccaaagcaaatatttcaaaatcaactgactagtgcaggaggctgttgattggctcttgactgtgatgcccgcaattctcaaaggaggactaaggaccggcactgtggagcaccctggctttgccactcgccggagcatcaatgccgctgcctctggaggagcccttggattttctccatgcactgtgaacttctgtggcttcagttctcatgctgcctcttccaaaaggggacacagaagcactggctgctgctacagaccgcaaaagcagaaagtttcgtgaaaatgtccatctttgggaaattttctaccctgctcttgagcctgataacccatgccaggtcttatagattcctgatctagaacctttccaggcaatctcagacctaatttccttctgttctccttgttctgttctgggccagtgaaggtccttgttctgattttgaaacgatctgcaggtcttgccagtgaacccctggacaactgaccacacccacaaggcatccaaagtctgttggcttccaatccatttctgtgtcctgctggaggttttaacctagacaaggattccgcttattccttggtatggtgacagtgtctctccatggcctgagcagggagattataacagctgggttcgcaggagccagccttggccctgttgtaggcttgttctgttgagtggcacttgctttgggtccaccgtctgtctgctccctagaaaatgggctggttcttttggccctcttctttctgaggcccactttattctgaggaatacagtgagcagatatgggcagcagccaggtagggcaaaggggtgaagcgcaggccttgctggaaggctatttacttccatgcttctccttttcttactctatagtggcaacattttaaaagcttttaacttagagattaggctgaaaaaaataagtaatggaattcacctttgcatcttttgtgtctttcttatcatgatttggcaaaatgcatcacctttgaaaatatttcacatattggaaaagtgctttttaatgtgtatatgaagcattaattacttgtcactttctttaccctgtctcaatattttaagtgtgtgcaattaaagatcaaatagatacatt

SEQ ID NO: 308 - DNA, 455 bp, Homo sapiens
  misc_feature (20)..(20): n is a, c, g, or t
  misc_feature (296)..(296): n is a, c, g, or t
  misc_feature (302)..(302): n is a, c, g, or t
tttttttttttttttttggnttttttttttttttttttttgagacagagtgagactcccaggctggagtaaaactccatctcaaaataaaataaaatctaacacttcaactgcacttactatatgcgaggaacagttctaagtattaagctgtattcatttatcctcaacaaaatcatctgtttacaaaacaagaggcgtggggtttaagaggaccaggcgtcgtggctttccggaagcaagcccagaggcacactaggagtcacgggcctaggcagcgtctcctctccacccggncacggncaccgctgccctgtccctggagcaaagtgaccccccccctccagggctcagcctcaggatggaggctcctagtctcccgcagggagagcagtctccagggctcctcttctttttcccaccaccaactcccaaggatccaggccccctcctcta

SEQ ID NO: 309 - DNA, 483 bp, Homo sapiens
agtttacatgtttgaagctgggtcttgatatacgggataagagtgttttcacaatttgtacacaaatccttggctacacctttcttcaaatggtggaacctagttcaccacctcgagtatagcctgcccttagttaccctcatttctaagaaatagaatgtggcagaaaggacaaagtgtaacttctgagactatatcaaaaagtggcatgtggcttcctcctggctttctctgggatcagtagttctgggtaaaacaagttaccctgttgtaaagacattctagcagctctctggagaggctcctgtagcaaagaagtgaactctctcagtagccagtgaggagctgagactgcctgtcaacagcctggggactgagcaatcttagaaatggattgtccagacccagtgatgccctcagatgacttgtagaccaacagtgtgcagaagggtagatttttaaaaggttaaaaaaaaaaaaaaa

SEQ ID NO: 310 - DNA, 1463 bp, Homo sapiens
gcatcccggtggggagaagggccaggcagagaaaagtagtcagaaacagagcaacaggtgaggctgaggcaggagattgagctgacactcaagccaaggaagggggaattaggaaacaattagaaaaaaagtaaagacagtgaaaaagtcagagacagctgcctgcacctacacacacattcagagacagagtcccagagggtggcatacacagagggagaaggggagggaacaggtgtggagaggagctgcggaagcagagaaatctcaagtcagagattcagggacacttggtccccgtggcgagccatggaagcagaaaggaggcgccaggctgagaagccaaagaaggggcgagtcggcagcagcctgttgcctgagagacacccggccactgggaccccgaccaccacggtggactcgagtgctccaccctgcagaaggctccctggtgcaggaggggggagatcaaggttctccccgcaaggaggacagaggggccgcccgcactcccggcgccgccaccgcaccaccttcagcccagtgcagttggaacagctggagtcagcctttgggaggaaccagtaccccgacatctgggcccgagagagtcttgcccgggacactggcctcagtgaggcccgaatccaggtctggttccagaaccgcagagctaagcaacggaagcaagagcgctcactgcttcagcctctggcccatctgtctcctgccgccttttccagcttcttgccagagtccactgcttgcccctattcttacgcagcaccaccaccaccagtgacctgcttccctcacccctacagccatgccctcccttcccagccctccacaggaggcgcctttgctttgtcacaccagtctgaggactggtaccctaccttgcacccagcccctgccggccatctgccctgccccccaccccctcccatgctccccctcagccttgagccatccaagtcctggaactgaggtcaaacaagtaccaccaaggtgatccccagcctgcggccctcgtgaaaagacaagaaaatggggtggcttcctttccatctatgggtgaagcagatgcatggtgagggtcagctcaccgattagaaatttaaaaatgggagatcatggtgaattctcactggggtgattagtggaggaagtctggggaggtgagctactggaagagacagggcaagatgcctcggtggagctgcctgctgaagggtgatattgatgaagacagttgctggtgagtggagatgattgaagggctaggaggtgagggccttcattaattgagatcacgattgaagaagatcccagctctttctggctgatttcagtaaggcttctgacttaagagtctacctatacatcccttccccattgcccaccccgccatctcaatcagtcactgacttttgtttattctgtcctagaatacctttttt

SEQ ID NO: 311 - DNA, 717 bp, Homo sapiens
atgccattacaggagttggtgtcctttgaggatgtggctgtgggcttcacctgggaagagtggcaggacttggatgatgctcaaaggactctgtacagggacatgatgctggagacctacagcagcttggtgtccttggggtaccacattaccaaacctgaggtgatcttcaacctggagcaaggagaaccttggatggtagaggacaccagagcctcccagtgttttgaatatagtggacggaggaatgccttcaacgtggaggctatattaacacataagagtgcttctatgggaaagacctcttgtaaatctaataaatgtgggaaagcctgtaatgagtcagctactattgctcaagagctaactcaggtagggaggaaaacttttgaacgtcatgtatgtgggaaaatattcagtaagaagcataaagtcactgaacataagaaaatacactcaggaaagaaaccttataaatatagtgaatatgagaaagccttcattagccaatcatgtgttacaaaacatcagagaacacatacagaagagaaaccctatccatgtgccatatgtgagaaatccttctgtcagaaatcaaatctaagcgtttatcagagaatccacacagagggaaaatcctattttgctaaaaacattttggcagcagtcagcactcagggtgcatcagagaactcacacaggggaaaaaccctatga

SEQ ID NO: 312 - DNA, 4337 bp, Homo sapiens
atgaccgtcactgcagattttcaagcaaatgcccaggaaaaccatgggctggctgtgcccaccccctcggttccagatgattttgcagacaaagaagtgacaggtaccagctcactagtcaatggcaacctccgactgtacagctctgtggcccccccaccgcctcctgtgccagccccagcacccccagctccagcatctcctcacacagtggggactcgtctctttccccctgggggtgtcaccaagtggaaatcagatgtagcactgaatggcaggcaggcagaggccaccagagccagccccccgagaagccctgctgagccaaaggggagcgccctgggacctaacccagagccccatctcaccttcccccgttctttcaaagtgcctcccccaaccccagtcaggacttcgtccatcccagttcaggaagcacaagaggctccccgaaaggaagagggggccaccaagaaggctcccagccgactcccactgcctcccagcttccacatccgccccgcctcccaggtctacccagacagggcccccgagccagactgccctggggagctcaaggccacagcaccagccagcccaagcccagagaacacagcgtcttcagcacctgtggactggagggaccccagccagatggaaaagctgcggaacgagctggcagcctatctctgtggctccaggagagaggaccgattcctcagtcacaggccaggcccaacagtggcccctcagagcaaggagggcaagaagggcccccgcctgcctgagaaggagactctcctgagcctgccagcaaaggacactcccccaggtgttcctgaaaagagtcttggcggcagcagcctgacagagacagaggctgcccccagcctgaccctgccctctgtggactacattccccaagactctccaactcccagtgtgcggcagatccggaatgagctggaggcccggctctcctcagcagcagagaaggaggctaagcccagcataggatctctgccccctaagcctcggctagaagggggaagaatttgtgaaaacggggctgatgatgacaaactctccaagcctgtggccaagaatctgccacctcaatccaccaccctgctgccaactacatcactccagcccaaggctatgttgggaccagccataccacccaaggccacacctgagccagccataccacccaaggctacactttggccagccacaccacccaaggccacacttgggccagccacaccactcaaggccacatctgggccaaccacaccactcaaggccacatctggccctgccatagcatctacagccacaactctgcccaccaccacatcccaactgatggcagagaaggactcaggcccagctggccagccagagaagccagcatctcaagaagtttccactccctcccaggcaaggggagaggggtccccctcagaggccactaggctgcccacacagggagcccgctcatctgcagccttcccaccaaagacatctcctggtggaggagaggtgccatgtctctacaagccccactgccaccagagcagcctcagccgtgaggttgctgtggtgatgcccaccctggccagaggaggggctgcagggccaggggagcccgtggaggtgaaggagcccccagggctgccagccaagcctcctgcctcggcccagcccactgatgaactcctcaggcacccggtgactggggaggtggtggagcggggctcgccgatggccctgctcctggcggccaggcagagggctcagaagggaaggtctgtaggggctgccctgggtcggtcctctctgccaggaagtctccgtgaccacagccaccaagccgaggccagctctgacagcatcttccacagccagggcacgcccaactccttcactgtggtgcccaagttacccaaggaggctgagaaggactccccgctgacgaccgaaatacccaataagtgggggccgcggctgggaagagacgcagagggcacagagctgagccgcaggcacaactggacaaagccagagccccaggcccctgtggcctgggaaagagtagctccctccaacctcccccagggccacccgctgcccaagtccttctcctccccaccttctccttcgaacaagagggaggaggaggaggaggagttcaacttcgaggtcatcccaccgccgccagagttcagcaatgaccctgagcccccggccccggccctccagtatctgggccgccagagctcccctccccggaacaactactcagacttgaggcagctcccgaacgctggccccggggcgcccccggctctcggcttctcgcgctttcccgcgggcgcgcgctacgccggggctgggggcctggagcgcttctcgggagggggccgctcgctcataaagaagcgcctgtacgtcggggagccgcaccgaggcccagggctaccccacggtggcaccggccgcagcctgagctctcccaactgcttcgggccgcagcccggaggccccgagatgcggcgcgtgaactcggcgggtcgcgcgccccccggaggcctgcacgcgccgaggctgtccctggagggcgccgcccggggcgccgcggaggccaagcacaaagcgcccggcagcgccgactacggcttcgccccagctgccggcaggtctccctacaccaccacccgctatggaagccccatcaacacgttcaccgtgaggcctgggacccgccatcccatctcctatgtctgctcaggggcccatcggaaagccacctcctgagccaggggttctcttagctctactccaacaaactgtgtctttaaggatctgggcacttgtttcttgtggggggtgggaggtacacagcaggtgttgggcgacctgactcagacacagaggagtctttgatccccaaagaccaacgatgagaagcagtggcccaggaagaccgagagtgggcttctgtttcccaaagcgctggtgtgactgtggactgtttacacgtggggggtgggaggggaaggagggtagagagaaggaaccattaaggacctgggcgctgagtttctgctctctggtactatctgctttagcaagagttatttaaaacagttttacaagcacggcctactgagcaggttctgaaagcaaggggtggggcactgactgaactggaacccatcgagatagctgtgattgcctgtcaggcccttgcaaagggctgaggcccagctctgtctggtgggtgtgcagggcaccgaagggagatctttagcctccatcacctgccatcccaagcaagagtggacacctggggttcctagccgcattgaggtgggaccaggaatgtgtatgtataacatgtggagaaggaccatgtgtggggtggggagtgaagctcccacatgtggaatggaagccctttgcattggccaagggcagaggtgggagattgatggttcatttttccttggccctagcccttagctacagggaggcctagagagaggacacttggcaagtttaggatgggaaacaaggttaagcctggctttgctattcagacctgtgcagccctgattttggggactgggcccaaggagccatgagtcttaggcttgacactaggggccttacatggccaggtctcatatgggatttggagaaggcatttttcctaacactgatactacaagtcaccaatactcttgatgccttaagatgctagaaagccttggagagtggaggcagcagagatgggaatggaggtctgaagaagcttgctgctgttggggaatgtgtttgggaaagtcaagagtggtaggattggttggctgggcgcggtggctcacacctgtaatcccagcactttgggaggccgaggccggtggatcacttgaggtcagaagttcgagaccagcctgcccaaatggtgaaaccccatctctactaaaaatacggaaaaaaaaaaaaaaagagtgctaggattgggccagttaagagcaggggagacctggctgggcatggtggctcacacctgtaattctagcactttgggaggctgaggcgggtggatcatgaggtcaagagattaagaccatcctggcctacatggcgaaaccctgtctctactaaaaataaaaaaatgacctgggcatggtggtgggcgcctgtagtcccagctactcggggcgctgaggcaggagaatcgctcgaacccaggaggtggaggttgcagtgagccgagattgcacaattgcactccagcctggcgacagagcgagactcgtctc

SEQ ID NO: 313 - DNA, 3455 bp, Homo sapiens
gggcggggcggccgcgggtcgcgggcggatgacgcgccggggccggcggaggagcagccacttcctggggccgccggccggggccgctggctgcactcagcgccggagccgggagctagcggccgccgccatgtcccaccagaccggcatccaaggtaacagcgcccggcgcgactcgcagggaaggggcttccgggagagccgggagagccgggagggctgcaggaccggcagggctggagtcgggccgggagctccggaagtcggtctcgcggggcgagccgggcctcggcgcctctccgcgctcctgcttcccgggcgctgccggcctgcgtcctcctccagcccggtccctgctgccgtcacgttgcagattgatccgaaattcgggggagcgaaggaaattggctttcgaggcggcctggttgaagggggcgtgccttccaccgtccccgacagtcgcccaactttcccccttttggtcacgtagggaagagctgggacagtggaggcgactggggcttcagtacgctgtcgagaaccagcaagtgaagatgttaaagagatctttgccagagccagaaatggaaagtacagacttctgaaaatatctattgaaaatgagcaacttgtgattggatcatatagtcagccttcagattcctgggataaggattatgattcctttgttttacccctgttggaggacaaacaaccatgctatatattattcaggttagattctcagaatgcccagggatatgaatggatattcattgcatggtctccagatcattctcatgttcgtcaaaaaatgttgtatgcagcaacaagagcaactctgaagaaggaatttggaggtggccacattaaagatgaagtatttggaacagtaaaggaagatgtatcattacatggatataaaaaatacttgctgtcacaatcttcccctgccccactgactgcagctgaggaagaactacgacagattaaaatcaatgaggtacagactgacgtgggtgtggacactaagcatcaaacactacaaggagtagcatttcccatttctcgagaagcctttcaggctttggaaaaattgaataatagacagctcaactatgtgcagttggaaatagatataaaaaatgaaattataattttggccaacacaacaaatacagaactgaaagatttgccaaagaggattcccaaggattcagctcgttaccatttctttctgtataaacattcccatgaaggagactatttagagtccatagtttttatttattcaatgcctggatacacatgcagtataagagagcggatgctgtattctagctgcaagagccgtctgctagaaattgtagaaagacaactacaaatggatgtaattagaaagatcgagatagacaatggggatgagttgactgcagacttcctttatgaagaagtacatcccaagcagcatgcacacaagcaaagttttgcaaaaccaaaaggtcctgcaggaaaaagaggaattcgaagactaattaggggcccagcggaaactgaagctactactgattaaagtcatcacattaaacattgtaatactagttttttaaaagtccagcttttagtacaggagaactgaaatcattccatgttgatataaagtagggaaaaaaattgtactttttggaaaatagcacttttcacttctgtgtgtttttaaaattaatgttatagaagactcatgatttctatttttgagttaaagctagaaaagggttcaacataatgtttaattttgtcacactgttttcatagcgttgattccacacttcaaatacttcttaaaattttatacagttgggccagttctagaaagtctgatgtctcaaagggtaaacttactactttcttgtgggacagaaagaccttaaaatattcatattacttaatgaatatgttaaggaccaggctagagtattttctaagctggaaacttagtgtgccttggaaaaggccgcaagttgcttactccgagtagctgtgctagctctgtcagactgtaggatcatgtctgcaacttttagaaatagtgctttatattgcagcagtcttttatatttgacttttttttaatagcattaaaattgcagatcagctcactctgaaactttaagggtaccagatattttctatactgcaggatttctgatgacattgaaagactttaaacagccttagtaaattatctttctaatgctctgtgaggccaaacatttatgttcagattgaaatttaaattaatatcattcaaaaggaaacaaaaaatgttgagttttaaaaatcaggattgacttttttctccaaaaccatacatttatgggcaaattgtgttctttatcacttccgagcaaatactcagatttaaaattactttaaagtcctggtacttaacaggctaacgtagataaacaccttaataatctcagttaatactgtatttcaaaacacatttaactgttttctaatgctttgcattatcagttacaacctagagagattttgagcctcatatttctttgatacttgaaatagagggagctagaacacttaatgtttaatctgttaaacctgctgcaagagccataactttgaggcattttctaaatgaactgtggggatccaggatttgtaatttcttgatctaaactttatgctgcataaatcacttatcggaaatgcacatttcatagtgtgaagcactcatttctaaaccttattatctaaggtaatatatgcacctttcagaaatttgtgttcgagtaagtaaagcatattagaataattgtgggttgacagatttttaaaatagaatttagagtatttggggttttgtttgtttacaaataatcagactataatatttaaacatgcaaaataactgacaataatgttgcacttgtttactaaagatataagttgttccatgggtgtacacgtagacagacacacatacacccaaattattgcattaagaatcctggagcagaccatagctgaagctgttattttcagtcaggaagactacctgtcatgaaggtataaaataatttagaagtgaatgtttttctgtaccatctatgtgcaattatactctaaattccactacactacattaaagtaaatggacattccagaatatagatgtgattatagtcttaaactaattattattaaaccaatgattgctgaaaatcagtgatgcatttgttatagagtataactcatcgtttacagtatgttttagttggcagtatcatacctagatggtgaataacatattcccagtaaatttatatagcagtgaagaattacatgccttctggtggacattttataagtgcattttatatcacaataaaaattttttctctttaaaaaaaaaaaaaaaaaaaaaa

SEQ ID NO: 314 - DNA, 618 bp, Homo sapiens
atgcctagtgcggggccgctgagcgggcgcccacccaaaacctgtgccagcctaagagcgcccagtgcagccccggctcccacctgcgcctctccctccacacctcccagcgagcagagggagccggttctggcctccacaggccaagagaaaggcccccacagcacagcggatcctccgtccactcctcacagcctgtttactactctaatgagcagagcttcatgtgcttttagtaacggcagtgatgaagatgacctccctccagacctggccgaggcagtgggagtgaccacatctacaaccacaaacaccacaacggccgccactcaagtctccatgccactgccgtcccccaaggtccagaatgtcagctcgcctcacaagtcagaaggccaaggcctgctgtcccctggggccaagggtggagcgggaggagaagacagtgggagcatccccccaactattttctctcctcagttcctaagtcccagcactgtgttaaatattccacccaaggttgcaggcgtagccttccaagccatggaaccagatgaactaagtgattggattaactatgctttacccacagaacctcagcttatctgcctgttgtga

SEQ ID NO: 315 - DNA, 945 bp, Homo sapiens
atggatggaaccaatggcagcacccaaacccatttcatcctactgggattctctgaccgaccccatctggagaggatcctctttgtggtcatcctgatcgcgtacctcctgaccctcgtaggcaacaccaccatcatcctggtgtcccggctggacccccacctccacacccccatgtacttcttcctcgcccacctttccttcctggacctcagtttcaccaccagctccatcccccagctgctctacaaccttaatggatgtgacaagaccatcagctacatgggctgtgccatccagctcttcctgttcctgggtctgggtggtgtggagtgcctgcttctggctgtcatggcctatgaccggtgtgtggctatctgcaagcccctgcactacatggtgatcatgaaccccaggctctgccggggcttggtgtcagtgacctggggctgtggggtggccaactccttggccatgtctcctgtgaccctgcgcttaccccgctgtgggcaccacgaggtggaccacttcctgcgtgagatgcccgccctgatccggatggcctgcgtcagcactgtggccatcgaaggcaccgtctttgtcctggcggtgggtgttgtgctgtcccccttggtgtttatcctgctctcttacagctacattgtgagggctgtgttacaaattcggtcagcatcaggaaggcagaaggccttcggcacctgcggctcccatctcactgtggtctcccttttctatggaaacatcatctacatgtacatgcagccaggagccagttcttcccaggaccagggcatgttcctcatgctcttctacaacattgtcacccccctcctcaatcctctcatctacaccctcagaaacagagaggtgaagggggcactgggaaggttgcttctggggaagagagagctaggaaaggagtaa

SEQ ID NO: 316 - DNA, 585 bp, Homo sapiens
gtgcattctgggtgtccacatatttgttgttgctttaggaagaggagctgggaggttggagtcgccacacatgttgaaagatgtggcaaaaaacaaacaaacaaaacacctcatagagagaaatcctgactttgtgcacaagaaaagggagtgaagtgtgtggggtttttaaagtggtggtgggggggcattaggagatacccagaagctctcaagattccaaacagtctgcttttcttttcagacattacactccaagaaaagaaactctagtgtataacagaggggctctgtcaaaatttaacaacataaatattgggcaaatgaagttgtttctctggtgctatctcaacctgccaatggagaaatatctcaaaaagtcaagaattgaagccattactcagagacagcatcctatggcatggtgatccaaaacaagtacacctctaccttttccctttcagccccaaaccccaaaacactggagaatattggggcaggcaaggcccgtgaataggtgagcagagctggaagaagagactcctgcccctggtgggcctcaggctatttgtggaatgatgtttg

SEQ ID NO: 317 - DNA, 408 bp, Homo sapiens
gagacgattagctctgggaacggctcgttctggcaggacaggctgagttcagaagcagcctcctgcaggaacatttgaccaatggctcggcaaagacctaacctgcacgtttccctgtgctacatgtgtcatgtgttcagcgcatgtagctccagggctcgggacttgtttacttggtggaagaggcagcggacctgcggagtcaggccatgtgattgttggctctttggctgatcatggacagctgacccgccggactgcacacactgccatctgctgccaggggtctgaaggagccaagggagggtgaaggagagtattccagaagagacaacagcttaggcaggcaggacctcgccatggaggaaggtgctttctgatcactgcgggacacctgtgtgatagctc

SEQ ID NO: 318 - DNA, 566 bp, Homo sapiens
  misc_feature (170)..(170): n is a, c, g, or t
atagagactcacaggctggatgaagaaaactgcctggggaaggggatccctcctccaggcagtgctggcaagaggctccctatgatggcacctactgtggatgaggtacagggtttttagactcacagcagctccaagggcctttccctctccttcgttttacaggaacntgattctaatctgaatgtctgggccacatcccatggtgaggtccagcctcagctggatgaaaaacaagactgcctccaacctagaacaaccagctgttcattgttttcttctgcctaaaatcttcacttccttgggagaattgctccccacacaccctgaccatgcaggaaatgattctgattggctccttctgagtactatggtgccatgctcccctggccataggaatggattctcactcagttttccacagatatctattgagtgcattgtcttggcactggggcttcagcagtgagcaagaccagcagcctctctgcctacatggagcttagattctactggaagaggtggacaataacacagagcgaaaagtcaatagtatgctttttaac

SEQ ID NO: 319 - DNA, 913 bp, Homo sapiens
tcaggaattcttttttggatgcatagttattattttttaaacaaactcagattttcaaacactgattttcttctctgaacgggcattgcattgttttaaacagtagctcctggaataatgccacctttagtattttagactttcaaacaacaattggaattggataaatgctttcagctgggagcactttcctaatacctttgtaggtaatgggattctctatttgtgctgggtgacaaacggacagtgccctggacagactgcctaccctctgcagaatctaccaaaaagtagagttttcccatgagactgcttgtggtccatctaaaaatgaaaaaataatcagagaaaatgcgcaaagccttttctaactacagttatgaaatgatggcttaaagaggtatttagaaaataagagtggagtaatacagaaacaaaatctgaagaagaaagtttgcttaggagctgatgctctttgtctacaaacaagagggtaaggagctggatccaattgaattgaattgtttttgtttgcttgtttgttttcttccattcagtgcctttcaaactgttttttactggatgaagaaactcaaccaagaaaatatatgtcgattcttgtatatgggacaatattagctgctgtgatttttaatactagcataaaatataagaatctttttattactgtgatattgttttttcctaaatgaatgcatagtgtacaattggtgtcaaaagcattgaatttttttcagatggattaagctggaataataaagtatatctatgagatgatttctgtaaactctgacttgctgagaaaaaaagtgagaaagctttttctggaagaaacatggcaacttaaccgttaattaatctggactcaataaaacaggaamgtgcttcttta

SEQ ID NO: 320 - DNA, 570 bp, Homo sapiens
atgattcctgttttatctgcattaggagaggtctgggaatgtgaggaccagagaaaggaacaacacaaaggagaaggacacgaggtggtgtttgatagggacacatgtccttatgaacacgatggaagtatctctggaaatgaatacaatgacagtgaatgtggactgtccgttagaccgaaatctcatttcatcagtcaccagaggactcatactggagagagcccttatacctgtaatgactgtggaaaatccctctctaagaattacaacctgattgtacatcaaaaaatccacacaggagagaaatcctataaatgcaagaaaagtcatactgtggaaaaactattcgaatgtaatgaatgtgaaaaatccttttctgatgtctccaaccttattgtccatctgagaattcacatgaacatcgcgggcctcatctggcaccagaggactcatactggtgagaagccctacgagtgtaatcggtgtggcaaagccttcagggacagctcctgtctgaccaagcacaagaaggtacatgctcaggcgaccttgtgccagtgtgtctag

SEQ ID NO: 321 - DNA, 2049 bp, Homo sapiens
gagtgaaagcggcgccgcccgccggccgcaggtgcggcaaagccagtgtcatctgccggttctcttagggctcccggaaagaaggagggctagccgcgtgcgttcgcgccgcgcctccttgcgtttctgttccccaaatagggcctctccttctcccgccgcccaggcccctgcgtgggctggacgcgtcagccccacacattagcctcgctgcggcgcccagactctgctttgcctccccgtcccggtccctggcccctgccctgtcgcccgccgccggagcggtgaccgcccggcccgccgttcttctgctgccaccgctgtcggcaccatgggcagtgagcagagctccgaggccgagagccgacccaacgatctgaactcctcagtgactccttcaccagccaagcatagagccaagatggatgatattgtggttgtagctcagggctcccaggcctcacggaacgtcagcaacgatcccgatgtcatcaagttgcaagagattccaaccttccagccccttttgaaagggctattgagtggccagacttccccaacaaatgccaaattggagaaactggactctcagcaggtgttgcagctctgcctccgatatcaagatcacctgcatcagtgtgcagaggccgttgcttttgaccagaatgctttggttaaacgaatcaaagagatggatctgtctgtagaaactctgttcagcttcatgcaggagcgccagaaaagatacgccaagtatgccgagcagatccagaaagtgaacgagatgtccgccatcctccgccgcatacagatgggcatcgaccagactgtgcccctgctggacaggctcaacagcatgctgcccgagggcgagcggctggagcccttcagcatgaagcccgaccgcgagctcaggctgtagctgccgcccggcctgcctggggctgggagccccagacaccgacaccctgaggacgtgtggagctaaggtcatatcatctgaccaggtctggaggctggcgggaggctccctgaaagtgggtgcgaaggagtccggctggcatgaaaatctgactttgcccagctcttttccttgatgcagtttcccagtgtggaaggaacctaaccagttctcggtgataactgaagctggaacgtgtgaattattaggaattctttgaagaactctgcattgagaattatttttatttagttttttttttttttaattgagagtatatagtccagtccaggtaccggaataaaaatatggagacaaggggaaaatattttacgaagctctgtgttctcaacgccctcatgaacttttcagtaggctgtctggtttatgtgtggtcaacttgaaaaactaattgaatctaggtctctgtattgttcctgtttctaccctgactgtttccgtcacaccaagcccttatctggggcgcgtcttcctgcccaggtggaacactggcattttgttgactgtcaggttaggtgtcccttagtcgtcatcagaagctgaagccttcctttccacaccctcatcagattcatctccactgataaccggtttccttgatgcagacatagtttagctttctttgactgcagagatgtctcattccacagacatttcttgaacccatttgatgtgtccaatattgtgccagggatacaaatatggccgtatagcctcaggccttcatttctgaaaagaaaaaagctcaaaaagctgctgaatttctctgggagtttaggaaaggaagttatttgagtaacaacaaaagtgcttagtgtcgtactttacacatcataggtgttctaatggaagcaaggactggagaagcaaagagtggaatgtgaggagcagacctaggcagacaccttgagactaaaagtcagagctgaagggagtcgctggggccaggacggcatgcaggcctgtaccctgttccctaagttcctgcaagcgtcgggaggtgtgttttcagataccagaaagagccttcagtagattcacaagattaaaattgatgcgcttaattt

SEQ ID NO: 322 - DNA, 789 bp, Homo sapiens
atggggtgcccctctgcagccgaccgttttcctagaaggcctaaccgctcagacgggcaggggaggggggcgggcggcccgggagaaaccgagtccccgccgggtccccaccgtgtggcgccgaccgaaataactccagtccagctgcaaaaaccctcccgaaaacccaagcttctccggcacaacttcggtctctccagcctcattcctccccgcactccgccaaactgctcgccctgcccagcgcagcggatgcaagcgctccccgccccgagcggctacctgtcccgcgggccggggatcgcgggccggggatcccgagcctcacctcacctcaagcgaagggcagcgcgcgggcgcccgcggaagagcccagggagcatggctccatgtagtccctcccggaactttcctgacatagcacttctctcctccgctgcagagaacaacgctgccaggcggaggaggaaggaggacaacgaagaggaggtggtggcggcggcggcgatacaggcggcggtggcgggagctggagctgaaagtgaggagcatcgcggacgagcgccgccgcctcgcgagccgccgaggggttcccgcccccagggtaaccaacgctccctcttaaaggcgccggccccggttttagaccgggaggtcgcatcgttcctccgcctgggcaaaggcatcgagggtaccgcaagtgcgcccacccggcactggggcaaccctcgtcgttggcctgcgccctgcaccccgcgcctcgctcccagacggtcgccccgcccctaa

SEQ ID NO: 323 - DNA, 509 bp, Homo sapiens
cggccgccgctcggctccctgggggcggcgcgccctctgctggcccgctatgagccctgcacctggcgctggcgggggcggccgtgcgaggtgggtcggccgctgcccgctctgcccagttcagcttctgcttctgtgtccctgtcactttgtgtgtgtctgcgtctgctgactggtccgttttggttctggctattttcccgaaggtctccaggcccccagtgtaaacaaacttcctgagattccttctcggtcccctcaaatttcacaagaatgcgtgcagcaccttctgcctcaggtaaatcggtctctggtctcagtgggtgcgagtggggaccagaaacttgaaaggtgagctgacagcagaggcacctgagtcttgcccggggtccaccctgatataactcggacaagtcatttttctcacttttcgcattagtgacgtaactatgaatagatttctcttccagccctacctttctgtgattttaaataaacctccacgatgc

SEQ ID NO: 324 - DNA, 2429 bp, Homo sapiens
gtgccttatagctcccctcccagtggagcaggtgtctgagagtacagtgcagccctgcccttctgtccaccctacagagcccacggccatggcagcccaggcagctggtgtatctaggcagcgggcagccactcaaggtcttggctccaaccaaaacgctttgaagtacttgggccaggatttcaagaccctgaggcaacagtgcttggactcaggggtcctatttaaggaccctgagttcccagcatgtccatcagctttgggctacaaggatcttggaccaggctctccgcaaactcaaggcatcatctggaagcggcccacggagttgtgtcccagccctcagtttatcgttggtggagccacgcgcacagacatttgtcagggtggtctaggtgactgctggcttctggctgccattgcctccctgaccctgaatgaagagctgctttaccgggtggtccccagggaccaggacttccaggagaactatgcgggaatctttcactttcagttctggcagtacggagagtgggtggaggtggtcattgacgacaggctgcccaccaagaatggacagctgctcttcctacactcggaacaaggcaatgaattctggagtgccctgctggagaaagcctatgccaagcttaatggttgttatgaggctctcgctggaggttccacagtggaggggtttgaggatttcacaggtggcatctctgagttttatgacctgaagaaaccaccagccaatctatatcagatcatccggaaggccctctgtgcggggtctctgctgggctgctccattgatgtctccagtgcagccgaagccgaagccatcaccagccagaagctggttaagagtcatgcgtactctgtcactggagtcgaagaggtgaatttccagggccatccagagaagctgatcagactcaggaatccatggggtgaagtggagtggtcgggagcctggagcgatgatgcaccagagtggaatcacatagacccccggcggaaggaagaactggacaagaaagttgaggatggagaattctggatgtcactttcagatttcgtgaggcagttctctcggttggagatctgcaacctgtccccggactctctgagtagcgaggaggtgcacaaatggaacctggtcctgttcaacggccactggacccggggctccacagctgggggctgccagaactacccagccacgtactggaccaatccccagttcaaaatccgtttggatgaagtggatgaggaccaggaggagagcatcggtgaaccctgctgtacagtgctgctgggcctgatgcagaaaaatcgcaggtggcggaagcggataggacaaggcatgcttagcatcggctatgccgtctaccaggttcccaaggagctggagagtcacacggacgcacacttgggccgggatttcttcctggcctaccagccctcagcccgcaccagcacctacgtcaacctgcgggaggtctctggccgggcccggctgccccctggggagtacctggtggtgccatccacatttgaacccttcaaagacggcgagttctgcttgagagtgttctcagagaagaaggcccaggccctagaaattggggatgtggtagctggaaacccatatgagccacatcccagtgaggtggatcaggaagatgaccagttcaggaggctgtttgagaagttggcagggaaggattctgagattactgccaatgcactcaagatacttttgaatgaggcgttttccaagagaacagacataaaattcgatggattcaacatcaacacttgcagggaaatgatcagtctgttggatagcaatggaacgggcactttgggggcggtggaattcaagacgctctggctgaagattcagaagtatctggagatctattgggaaactgattataaccactcgggcaccatcgatgcccacgagatgaggacagccctcaggaaggcaggtttcaccctcaacagccaggtgcagcagaccattgccctgcggtatgcgtgcagcaagcttggcatcaactttgacagcttcgtggcttgtatgatccgcctggagaccctcttcaaactattcagccttctggacgaagacaaggatggcatggttcagctctctctggccgagtggctgtgctgcgtgttggtctgacccggggtttcggacatcagtgacactccctgccccactgcttgcttcttgtcaccccttctctacaattttgtgaacatttatgctccagtggcattcactggttgttcatacctttcttgccctgggtctatttcagcagcactgagctatgagctatgtaagccgacccggtgggcccagtggagggaaagcaatcaattaaagttgtgagccagaatggtttcca

SEQ ID NO: 325 - DNA, 509 bp, Homo sapiens
tttttttatggtgaggcagagggagtaacctttggcgtcaacagaaaagccactaggtttcctcttcttttcttccctggtgagtgatactttttggaagatatctcagaagttttttaaaagctcatttatgaaatataacaagacacattttcaatatcatggaacttaggaggatacaaaaagcaaatataattttaatcacaacaggaggagtcttttattgttttacccccactctcgggcatcctggacacgcattaacagtctacaacggagggctcattcacgattataaaagactgtgaaagatgagtaacgatttaaggcttctctccagaggcccttccccagctccaggtttaggctgaactgcccacggggaccattttcttgctgcctaatctccccctcttctcccgccccacgcggttccacccactcgcgcgtctcgggactctgatgaacgtcctaaactccagcctggacgctctgggctctggatctga

SEQ ID NO: 326 - DNA, 525 bp, Homo sapiens
tttggtttatatacttattcttttattttagtaattttaagtaccctagagaagaccacagtttagtcactggttcaatttgaaaaatttgataaggtagtaaattttacaagagagtgagctacttatttaaaacaggcatagtttttttaaattgtagtaaaaaacacataacctgtaatttatcatcttaaccattaagcatacagtttaataatgttaagtatgttcacatgttgtgaaacagatctccagactttctatcttgcaaatctgaaaccctataccctgccatggtttaaatgtcccctcaaaaaattcattttgaaacttactccccaatgtggcaactttgagaggtgaggcctttaagaggtaattggatcatgagggtttagccataatgaacagattaatccattcatgaattaatagattaaatggttaatggattcatgggttatcatgggagtcggactggtggatttataagacaaggactagaaatctgagctaacatgttca

SEQ ID NO: 327 - DNA, 1681 bp, Homo sapiens
ggggcgtgaagggagccgggatcagccaggggccagcatgagccggagggagggaagtctggaagacccccagactgattcctcagtctcacttcttccccacttggaggccaagatccgtcagacacacagccttgcgcacctcctcaccaaatacgctgagcagctgctccaggaatatgtgcagctccagggagaccccttcgggctgcccagcttctcgccgccgcggctgccggtggccggcctgagcgccccggctccgagccacgcggggctgccagtgcacgagcggctgcggctggacgcggcggcgctggccgcgctgcccccgctgctggacgcagtgtgtcgccgccaggccgagctgaacccgcgcgcgccgcgcctgctgcgccgcctggaggacgcggcgcgccaggcccgggccctgggcgccgccgtggaggccttgctggccgcgctgggcgccgccaaccgcgggccccgggccgagccccccgccgccaccgcctcagccgcctccgccaccggggtcttccccgccaaggtgctggggctccgcgtttgcggcctctaccgcgagtggctgagccgcaccgagggcgacctgggccagctgctgcccgggggctcggcctgagcgccgcggggcagctcgccccgcctcctcccgctgggttccgtctctccttccgcttctttgtctttctctgccgctgtcggtgtctgtctgtctgctcttagctgtctccattgcctcggccttctttgctttttgtgggggagaggggaggggacgggcagggtctctgtcgcccaggctggggtgcagtggcgcgatcccagcactgcagcctcaacctcctgggctcaagccatccttccgcctcagcttccccagcagctgggactacaggcacgcgccaccacagccggctaattttttatttaattttttgtagagacgaggtttcgccatgttgcccaggctggtcttgaactccggggctcaagcgatcctcccgcttcagcctccctaagtgctgggattgcaggcgtgagccactttcccagcctctctttgctttgcctgccccgttctcttaactcttggaccctcctcgtctgcatggtaactccgtctgagtctaccattttcttgctctccctccttccttgggcctgcctcagttccctttggcctccccctttacccagctcttggggtgtctctgttttttccatccccacttcctgccttctcgtggccctgtgtgagcacatgtgtacatctcagccttatctcaaggaggtgacaccttctctccttgtccccatctggccgtctctctgtgcttccctggccaggggcgtgcctgctggtcctatggggggaaggctactccgcatctcagccaccttcctcaggctcactccacctacatccccagtctgccacaccccatccctttgggcctcagccctgtccctttgatgtcctcctttccttcagcccctctgccctgtccctgcacacctccactgcctcccagcagatctgtggagacaaaacaagcaacaccttaaaagagttttatttctgaaaataaattaattttttgtaaataaaatgtttaaaaataaaaaagaaactaaagttaaaaaaaaaaaaaaaaaa

SEQ ID NO: 328 - DNA, 842 bp, Homo sapiens
ctggccgatccttttttattacaagagtttatttaaggtagacatatagatgtggagttgctaggttaaggaacgttatggttatttatgctgcataacaaaccactctaaaacagtagctcaaaacagtaatttatttttactcataagtctgcaatttgggtggggatggctcatttctgcgctacacagcgtcacccgatgcctccactggaactgagtatccacttccagaatgaattatcttcattactggcaaattggtgttgggtgtcagctaggagctccactagggctgccagctggggatctcaaattctgtctctgtgtggttctccatgtggttacctggacttcctcacagcatggcaggtgcattcaaaaagtccctggcagaagatcaaggtttttttgtgatcttgtgactaaaattctacaacatcacatatactgtattctgttagtcaagcagggactaaagccagtccagattcaatgggaggagccacaaggaatttgcagccattgtaagggtaccacactctcctctctagccataaatgattgacatttgtcacacatgcagaagaccttgaccttccaccaaggcccacagaagtgtgagctgtggtacattgggattagatctgaggaccaggattggtgagctaagagcagggtagggggaattaaggtcctggagggaagctcttaatacagaggcttgagacgtcgggacctttaaaaaagaaacagggatttgcccggactgcccaacttacagtgaaggaaaaaggggagggggaagggacgctggggggaaaggggggaaaacaacccta

SEQ ID NO: 329 - DNA, 1101 bp, Homo sapiens
gcttctgctccggcttggattgtagccttgacgaggtctgagcgaccatggaccggccggggttcgtggcagcgctggtgctgctgcattttttatcacctatgaatatgtgaagtggtttttgcatgctgattcatcttcatatttgacacctatgaaacatatgttggctgcctctgctggagaagtggttgcctgcctgattcgagttccatctgaagtggttaagcagagggcacaggtatctgcttctacaagaacatttcagattttctctaacatcttatatgaagagggtatccaagggttgtatcgaggctataaaagcacagttttaagagaggaggaggattagagtcaaaggtgtggggaggcttgtgagcttctgtgagttgttgtgtgtggcttgtatacatgctgttatactgattcctttttctttggtccagtttcccttatgggagtccttaaaagccctctggtcctggaggcaggatcatgtggtggattcttggcagtcagcagtctgtggagcttttgcaggtggatttgccgctgcagtcaccacccctctagacgtggcaaagacaagaattacgctggcaaaggctggctccagcactgctgatgggaatgtgctctctgtcctgcatggggtctggcggtcacaggggctggcaggattatttgcaggtgtcttccctcgaatggcagccatcagtctgggaggtttcatctttctgggggcttatgaccgaacgcacagcttgctgttggaagttggcagaaagagtccttgaagcagagacaagcctcacctccacttctgtcaagagaggggcctgcagtgcaaaccctcttccgctgagcagctgtctgaactataggccccagtgctgaagaccagttgtgctaagataccggcatggagattgtgccatccgtggtataggctggctggtatgaagtcattggcctgtatgccagagagctaagagaagaaaacggggtctgtggcggtactctgaacaatttcctcagaacctcttaataaataagtttggtaatgctgaaaaaaaaaaaaaaaaaaaaaaaaaaaaa

SEQ ID NO: 330 - DNA, 5284 bp, Homo sapiens
gattccagctctcgcgcccgacgaggtggatttggctgtccaccgagctccggcgcctgtcgttctaattgggtttggatttgcaccgttaaggaggggggaagagaaggaagaggcgggcgaggaaggcgagtccagctagcggctgttgcggggaccgtagccccagctgcagctccgaagaatcccccgccacggtttcggtggagcgtctgggcacgggatggagtgaaagagcgagtgcctctccaagcgggggtgggagggggtcaggctgtgcagaggagagagacagcgagaagaagccgcggctggctactgcgaatttgggattcgattgggagggaccgctcactcgggggaaatggattctttaccacggctgaccagcgttttgactttgctgttctctggcttgtggcatttaggattaacagcgacaaactacaactgtgatgatccactagcatccctgctctctccaatggctttttccagttcctcagacctcactggcactcacagcccagctcaactcaactggagagttggaactggcggttggtccccagcagattccaatgctcaacagtggctccagatggacctgggaaacagagtagagattacagcagtggccacgcagggaagatacggaagctctgactgggtgacgagttacagcctgatgttcagtgacacaggacgcaactggaaacagtacaaacaagaagacagcatctggacctttgcaggaaacatgaatgctgacagcgtggtgcaccacaagctattgcactcagtgagagcccgatttgttcgctttgtgcccctggaatggaatcccagtgggaagattggcatgagagtcgaggtctacggatgttcctataaatcagatgttgctgactttgatggccgaagctcacttctgtacaggttcaatcagaagttgatgagtactctcaaagatgtgatctccctgaagttcaagagcatgcaaggagatggggtcctgttccatggagaaggtcagcgtggagaccacatcaccttggaactccagaaggggaggctcgccctacacctcaatttgggtgacagcaaagcgcggctcagcagcagcttgccctctgccaccctgggcagcctcctggatgaccagcactggcactcggtcctcattgagcgggtgggcaagcaggtgaacttcacggtggacaagcacacacagcacttccgcaccaagggcgagacggatgccttagacattgactatgagcttagttttggaggaattccagtaccaggaaaacctgggacctttttaaagaaaaacttccatggatgcatcgaaaacctttactacaatggagtaaacataattgacctggctaagagacgaaagcatcagatctatactggcaatgtcactttttcctgctccgaaccacagattgtgcccatcacatttgtcaactccagcggcagctatttgctgctgcccggcaccccccaaattgatgggctctcagtgagtttccagtttcgaacatggaacaaggatggtctgcttctgtccacagagctgtctgagggctcgggaaccctgctgctgagcctggagggtggaatcctgagactcgtgattcagaaaatgacagaacgcgtagctgaaatcctcacaggcagcaacttgaatgatggcctgtggcactcggttagcatcaacgccaggaggaaccgcatcacgctcactctggatgatgaagcagcacccccggctccagacagcacttgggtgcagatttattctggaaatagctactattttggagggtgccccgacaatctcaccgattcccaatgtttaaatcccattaaggctttccaaggctgcatgaggctcatctttattgataaccagcccaaggacctcatttcagttcagcaaggttccctggggaattttagtgatttacacattgatctgtgtagcatcaaagacaggtgtttgccaaactactgtgaacatggaggaagctgctcccagtcctggactaccttctattgtaactgcagtgacacaagttacactggtgccacctgccacaactccatctacgagcaatcctgcgaggtgtacaggcaccaggggaatacagccggcttcttctacatcgactcagatggcagcggcccactgggacctctccaggtgtactgcaatatcactgaggacaagatctggacatcagtgcagcacaacaatacagagctgacccgagtgcggggcgctaaccctgagaagccctatgccatggccttggactacgggggcagcatggaacagctggaggccgtgatcgacggctctgagcactgtgagcaggaggtggcctaccactgcaggaggtcccgcctgctcaacacgccggatggaacaccatttacctggtggattgggcggtccaatgaaaggcacccttactggggaggttcccctcctggggtccagcagtgtgagtgtggcctagacgagagctgcctggacattcagcacttttgcaattgcgacgctgacaaggatgaatggacaaatgatactggctttctttccttcaaagaccacttgcctgtcactcagatagttatcactgataccgacagatcaaactcagaagccgcttggagaattggtcccttgcgttgctatggtgaccgacgcttctggaacgccgtctcattttatacagaagcctcttacctccactttcctaccttccatgcggaattcagtgccgatatttccttcttttttaaaaccacagcattatccggagttttcctagaaaatcttggcattaaagacttcattcgactcgaaataagctctccttcagagatcacctttgccatcgatgttgggaatggtcctgtggagcttgtagtccagtctccttctcttctgaatgacaaccaatggcactatgtccgggctgagaggaacctcaaggagacctccctgcaggtggacaaccttccaaggagcaccagggagacgtcggaggagggccattttcgactgcagctgaacagccagttgtttgtagggggaacgtcatccagacagaaaggcttcctaggatgcattcgctccttacacttgaatggacagaaaatggacctggaagagagggcaaaggtcacatctggagtcaggccaggctgccccggccactgcagcagctacggcagcatctgccacaacgggggcaagtgtgtggagaagcacaatggctacctgtgtgattgcaccaattcaccttatgaagggcccttttgcaaaaaagaggtttctgctgtttttgaggctggcacgtcggttacttacatgtttcaagaaccctatcctgtgaccaagaatataagcctctcatcctcagctatttacacagattcagctccatccaaggaaaacattgcacttagctttgtgacaacccaggcacccagtcttttgctctttatcaattcttcttctcaggacttcgtggttgttctgctctgcaagaatggaagcttacaggttcgctatcacctaaacaaggaagaaacccatgtattcaccattgatgcagataactttgctaacagaaggatgcaccacttgaagattaaccgagagggaagagagcttaccattcagatggaccagcaacttcgactcagttataacttctctccggaagtagagttcagggttataaggtcactcaccttgggcaaagtcacagagaatcttggtttggattctgaagttgctaaagcaaatgccatgggttttgctggatgcatgtcttccgtccagtacaaccacatagcaccactgaaggctgccctgcgccatgccactgtcgcgcctgtgactgtccatgggaccttgacggaatccagctgtggcttcatggtggactcagatgtgaatgcagtgaccacggtgcattcttcatcagatccttttgggaagacagatgagcgggaaccactcacaaatgctgttcgaagtgattcggcagtcatcggaggggtgatagcagtggtgatattcatcatcttctgtatcatcggcatcatgacccggttcctctaccagcacaagcagtcacatcgtacgagccagatgaaggagaaggaatatccagaaaatttggacagttccttcagaaatgaaattgacttgcaaaacacagtgagcgagtgtaaacgggaatatttcatctgagaaactgcagggttcctactactcttttttcttgttgttcaattatctcctccccctcttctctcctgtcttttgatttggtcattctctttattttctgcttgccatgtcttttctggaacatacttgcatccaccacagcatcaattcccttgatccagcccaagagaccaggcagccatggccactgccttcctctctgatgaacctatcgggtgaaaacgaccactcaagagactgacttcgccattcaagacaaggaagagacacatgtgtgcactcctgcatgttcagttctgtacttccagtttctaaaatgcactgttcagttttccaaccacttggtggttcaggcttgctttgaacctgagctcttaggcacatgacggtcattcctgacatcctccccagctcaagtctattcttaccatagaacccagggcagggagagaagaacctagaggcctggtttgctttggtggcattgtaaaaagagtaagagaggtttggtttgtggtggtttgctttctttaccataagcaatcccttgccttaactcatcaccctttttcactatgacccttagaccctgagtattttcaaatatatgattgctgatagtagtgaccaaaactactttgttcctttcttaccactctctcctggggccgacacgttgggacagcacaccatagcataaagctaggggatgcatggaaatagcagcttgaaactaggaggtaacaagaaagcttctaggaagtagatgttccatatcttcaaaatgcctcctccaattttgtaagaatgctagctaggtattcctgggattattatactgagatatatatatatacacacacacacacatatgtgtatatatgtatatatatatgtgagtatatatacacacacacacacacacacacatatatatatatacacacacgcacacatatatgttgctgcagcataaagaaattgaaataaaagtttaaa

SEQ ID NO: 331 - DNA, 1969 bp, Homo sapiens
atgccgccactcatacaactcaactcttcctccaaactcgattcaaagagcaatacacagagcgtcagacaaaggaacacaggacaaggcttgaaacatacaatcctggagaggcagacgagggcccaatggggccaaagggtgcacaccaccgatccaggcgggctggaccctgccccctccagcgacgacggtctcggggaaaggtggaaggggcgcctgcctaagggtgtgctaagcgggagtcagggcagcggacactataagggaaagggccccagggctgccactgccccctggcggctgaagccagagatccggggtaggtttgctttacgcaactggaagggtccaaggctcttcctagcagtcgctgtcgagcccctggggtcttggatcccgcaccaatggaaaatgaaagggccgccgatcctggaaagattcaacaagacctcatcagggcagctgctacctgagactctgactctgggcaccacccctcctgcagctgacttcacccgctctccactcctgcaccccctgagctgcatcggggcactgacccgctgcccctcctgctgtgcttgctggggtctccatggccggctgaaagctccggtggtggtgctggagcctggggtggccacattgatcccaaagctcccactgccagcgggggctgccgaacccccaaacgtgaagggtgatggtgttgtgctgccaaacaccgagctgctgctcccgctgctggcggtctgggtggtggctccaaagccggagctggtggctgcaccgaagaagacagcagtggagccgccaaaggcgggctgtgagctggcgggagcgccgaaggccgaagccgtggctttcaacccaaacgccgagtgcgtggcaccgccaaagataggatggatgggcgtaggcacgtacgcaggcacgaccttgatcatggacggaggtgcaggtgtgggtgcagcagccggggctgcagagtttccaaaagtgaaagagctgccaaagctgggggcaagggccggcttggcggcccccggtggctgcccctcagcggccccaaatgcgggctgggggttggctcccggatatgatgggagcggggacttggcgcttgagccaaagggaatgttgaacgtgggggtgctcgtgttactgaacgtcagagtgggctggctgctggtggccggggcggaggtggcgagggtgctgccaaaaccactaaagtcggcagcgctgctgctggtggccgttggcacggcagtgtgcagggactggctgaaggtggtgactgtggtggttgtgggcaaggcaggaggtttgccaaactggaatatggagcccatggccggggtgaagctggcagcagaggcctggggcgccccgaagaggaaaggctgtgaggcggcagtggcggtgctggtcgtggtactcacactgctgctgctcacactgtttatgccaaagccaaacgcaggcttcgaagcagagtctgtggatggactggcagaggtgatgggagccacagcagaggtggcgctggccaggccagtgaagagcggggcagttgtggtgggagcagtggcgggagtagttgtctgcttgaagaagggagcaggcaagggcacagatgcaggtggccccatgctgctaaagacaggctggaaggtcggggctgtggtgctggtggtcgtggggagggaggagctggagggcgctgtggctgtgactgaagggccaggcgcgccgctggctccggggttcacgctcgggggtcccggctcgagcctctacccggcccgcgcgaaccctgggccgcacagctcccgcccgcctaggtgctggcccgggcggtcagcgtccagccccgcagactcggtgattctcatccactagaggccaaagcctgggaactagagcaagcggtgacctgaagaggcgcaggaagcgagggcag

SEQ ID NO: 332 - DNA, 1599 bp, Homo sapiens
gtcacgccgagccagcgcctgggcctggaaccgggccgcagccccccggcttcgcccaccatctccctaccatggacccccgcaaagtgaacgagcttcgggcctttgtgaaaatgtgtaagaaggatccaagcattctgcacacccaggaaatgcgcttcctgagggagtgggtggagagcatgggaggtactgctactcagaaagctaaatcagaagaaaataccaaggaagaaaaacctgatagtaaggtggaggaagacttaaaggcagacgaaccatcaagtgaggaaagtgatctagaaattgataaagaaggtgtgattgaaccagacactgatgctcctcaagaaatgggagatgaaaatgcggagataacagaggaggtgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgcagccatccgagactgtgacagagccattgaaataaatcctgattcagctcagccttacaagaggcgggggaaagcacacagacttctaggccactgggaagaagcagcccatgatcttgcccttgcctgtaaattcgattatgatgaagatgctagtgcaatgctgaaagaagttcaacctagggcacagaaaattgcagaacatcagagaaagtatgagcgaaaacgtgaagagtgagagatcaaagaaagaatagaacgagttaagaaggctcgaaaagagcatgagagagcccagagggaggaagaagccagatgacagtcaggagctcagtatggctcttttccaggtggctttcctgggggaatgcctggtaattttcctggaggaatggctggaatgggagggggcatacctggaatggccggaatgcctggactcaatgaaattcttagtgatccagaggttcttgcagccatgcaggatccagaagttatggtggccttccaggatgtggctcagaacccagcaaatatgtcaaagtaccagagcaacccaaaggttatgaatctcatcagtaaattgtcagccaaatttggaggtcaagcataacgcccttctgataaataaagcccttgctgaaggaaaagcaacctagatcacattatggatgtcgcaataatacaaaccaatgtacctctgaccttctcatcaagagagctggggtgctttgaagataatccctacccctctcccccaaatgcagctgaagcattttacagtggtttgccattagggtattcattcagataatgttttcctactaggaattacaaactttaaacactttttaaatcttcaaaatatttaaaacaaatttaaagggtctgttaattcttatatttttctttactaatcattttggatttttttctttgaattattgggcagggaagatacttatgtgtggaagattattgctctaatttgagtgaaataaaagttattagtgcgaggcaaacataactcatttgaggataaa

SEQ ID NO: 333 - DNA, 2019 bp, Homo sapiens
agggcttcgggcccccggggccagccgccgtcctgcgaacgcgcggcgcccgggccgctgcccccttccggccccgcggcggccccgcctcctcccccgacttccttccctgagcacggcggcggcggggacgagcaccggcctgcgcgcggagccggcaccggatgacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttccttactgtctctcttgtcacatggaatctacatgtgtttgaactattgctttagggtttaaaataggggagcctgtggtggcctggtgcacagggctagaacgagagtgcctccccttcttgtgtcctggctggctgggatgctggtggctcttcagaggagcatcagctgtctgtcatctgctgcgatccggcagcctctcttcactgctacatgtgctggaaggacaaataaataattgtggttgtgttcttaatggggacgagcagacacactgatctgaacatctggcccaagtgaagcatggcatatagtgcccttggaagaaaattaggcctcaaatgacagtagcattgaagtgtttgctgcagagttgagggaaacccccagccaccctcccggaatccgagatagggtggcacatctgtcctgacagacgaggagtgtaactgaaccaggaatatttcctccattcctgctctcccactgcacacagggtggtggcacattatccctctggggggtggggacgcctgttgttttggctcaatttgggtttgttggtcacatggagctcttccatttcgtttagctgaataatgagttgttcctagaggagacagcctgtctctccttgttgcccccaaagcccatgccctgccgtggtggcagctggggctgtggatgggaggggtccccaacatggatgtgttgcccctcctccgcatgccaacgcagttcatgtacaaggcccctctgcaactggagagaaaattaattcctatcccgtgagtggattgtgagaaattccacccacgtggagacagcttactgcagcactgttggtgttcggagctcttctgtgccctggctccatgctttcacctacacaagcatcaccttcctaatcaccgcggggcggggagcgtgtggctgtgccccttctctttaatctcatttaatttttattaaacatgctcagtacctgtgttgagaaaaggctttctttatcctaaagattattacctttttaaagtgctcttatattttcatgagtttttattttgtctctgagattttgtattccacattctagggtattctgtaatttggctccttaccaatattattaaaatcttattaaaatctaccctaccaaagca

SEQ ID NO: 334 - DNA, 2751 bp, Homo sapiens
aagcagttccgggaaaccccgcgtgctgccgggatcgcgtctcagtccatcaggggggggagggggtggcgcgcgcgccatttctagtcgttttcaaagcgcctcgcgctgattctcacgggcccggctgccggcccccgctctgccctgcataataaaatggctaatcaggtgaatggtaatgcggtacagttaaaagaagaggaagaaccaatggatacttccagtgtaactcacacagaacactacaagacactgatagaggcaggcctcccacagaaggtggcagaaagacttgatgaaatatttcagacaggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaaccacaggacagaggaagtatggtggtcctccaccagacagtgtgtactctggcgtgcaacctggaattggaacggaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactgtgtgacagctatgaaattcgccctggtaaacaccttggagtgtgcatttctgtggcaaacaacagactttttgttggatccattccgaagaataagactaaagaaaacattttggaagaattcagtaaagtcacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaacattaaaaaaaaaaaaaaaaaaaa

SEQ ID NO: 335 - DNA, 68 bp, Homo sapiens
caccagtgatgagttgaataccgccccagtctgatcaatgtgtgactgaaaggtattttctgagctgt

SEQ ID NO: 336 - DNA, 1997 bp, Homo sapiens
gttacaattagcatcgtgatccaagcagatgctacatgaaagaggaatcgccatttactcagaaaaaaatgtcccttacaggaaccggcagcagctaggcaaagtcgcccgccggcctccatccaaaatcacgctcgcgtgcttcggaagcatccgagtcactcctttcccactttttcttgcagatcggcctgggccggtgtgggttctgtttctccccttggctgcctgtaagcccacagccttctggctgcaacattatagaattggccgtgtcccgcctggtgggggattggggatctgtgtttagccatttatatctactttagctgttaaagaagtccaaatgaaaatcaggtgatggtggaaccatggggacttgggggtggggcagaggtgggaacatttgtatcagttaagtcagcttcgtggctccctgtggagccagggctgagccttgtgacgcgcactcgccaattagagattgatcagccagcagtcaaatgcattctccagtccttgcaagaaggatcagccttttctgtgccagcctcgatcgccttgtgctttggtctctttttctcccctgcttggatcctgcctcgcgcgggccgtcctgttgctgagactcggggtaccgttctgctgacccagctccctttagtcacgtttgcttggctctggtaccaaatagttgggattaccgaagagtccccttcctcgcgtgtcagcacagatgctgtgactgccacccgcgtccccgtcaagtgcctgtgcccgagctcgccgccgccgtgtgtgctgcgctgattgagttatgaggtgcctttcccggaaccctcctctcgcccggacccaagagaggcgacagctgtggctggggctcttggtttccagagggtctggactggtttgggtgctttaaaatagatatttagttcagtggtgcttatgggggagatgggactagaacttaagtgtgagacttgggtggatgggaaagttaattattggtctcttcaagtttttttttttttcttttgctattgttaccacttgtcactgtctccatgttaaaatgccaaaaatgatctagttgttgttgcttttttccctattttccaccccagtcgctccttaccgtgactcctgcccttggagggcatgtagcagtatctgtcctgccagtcccaaggccctgtgggaggagactggcctgcatctctctaagacttagtctgacgccacgcacatctcttgttctgtgttcaatcagtagtccaggggagaagcttctgctacttcagagctttgctaaactaacctaatttgtccaaatcaccccataaccaccatctctgactcaagcttccatgtgacagcctgatccatttccctggagaagtctctttcctggaatgcagcccagacacctgtgctcctggcacccttgaggtctctcctttgagtcgtggtcaccgagagggttgaggacgcaccacccgaggtcccagcctttgcaggagccgccctgggcggagctggactcggatcttcggtggcctcatgtaaatccggcagccagcctcttctagaaccctagcccagggactggagcaggaaaaggaccttcaaagtgaagactgccttgtcccgcacctccttctggcttagattgaaaaatgggcttcctaataggttaaatcctttaaaacaaggagttgtgggggaagggtgtcacgcactcctagagaaaggtacacagttgtccggctgggaacgtgcttggcgcgaccctgcgggcatctgactggtcttccagctcaggaaaaagaatttgaaagaggcttagtgtgaaggggaatcaaagaggaggttgtgatttggtcgaaggtgcctggtttagtgctgtaattgtcttatttttttatatatatatttcttggagtaaacattttaaataaacgacatcattgtctactgaaaaaaaaagaaaa

SEQ ID NO: 337 - DNA, 1797 bp, Homo sapiens
cttcgtggactgggctgtacggtgcgcgtgacggctgcgtgcggcgggaatcatggctgctcgcagagctctgcacttcgtattcaaagtgggaaaccgcttccagacggcgcgtttctatcgggacgtcctggggatgaaggttctgcggcatgaggaatttgaagaaggctgcaaagctgcctgtaatgggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatgtcagcagataaaagtgacgagtggtttgccaaacacaataaacccaaagcttcaggttaacggaagacatgatgcagagcaagcctctgtgattcctgcccagcacctgtgaggcctgacgtgtcagttcccaataaatgctcttctgatttgtttcccgtacaggcaaggaggcttgggtagtgcagatttgtgtatttcaatctttgaaagctctgatgtaatttagaaatgaaatccaatcatgagtccaggtagagaacgcctgctgtaatctacactgttgctgggactgcgcattctgtatataactgtgttggatgagtgacagatgattgtccagactaggacagcggcatgaacatgactttggttgggattgcggatagttagggttacctctgaatcgtgtagcttttatgagagcagctgtgcaagtgaatccacattaatgccttgtcgtggtgccattcccagcgcctgacgatacgctcttctattgtcttattctggcaggttttgacgttttaaattttttaaagaaattttattccttggaccaaaaggtttggttaaccacccccctcttacttgctttcacattttgagtgtccagaggaaacagaaaggaatgagtgtgtgacgttgctgcacgcctgactctgtgcgagcttctttctgtgtatatattttgttttatttttttccgtgtatatttttaatcccgacagaacatcatgtgagatttctttaaaatggattaaacgatttcttcagcctgaaaaaaaaggttttgaaaatgttttcttgtagttttgtttggttctaaacaacaaataggttttaatcactcgaaatggaattatattgtgtattcattgaataaattttttttgaaagtaaaaaaa

SEQ ID NO: 338 - DNA, 889 bp, Homo sapiens
atgactagacagggagaaccccaggtccagttcaaacttgtattggttggtgatggtggtactgggaaaacgaccttcgtgaaacatcatttgactggtgaatttgagaagtgtatagccaccttaggtgttgaggttcatcccctagtgttccacaccaacagaggacctattaagttcaatgtatgggacacagccagcagggagaaattcggtagactgagagatggctattatatccaagcccagtgtgccattataatgtttgatgtaacatcaagagttacttacatgtgcctatctggcatagagatcaggtgagagcgtgtgaaaacatctccatcgtgttgtgtggcaacaaagtggatattaagaagaggaaagggaaggcaaaatccattgtcttccaccaaaagaacaatcttcagtactatgacatttctgccaaaagtaactacaactttgaaaagcccttccactggcttgctaggtagcccattggagaccctgacttggaatttgttgccatgtctgctctctccccaccggaggttgtcatggacccagctttggcagcacagtatgagcacgacttagaggttgctcagacaactgctctcccggattaggataatgacctgtgagaatgaagctggagcccagtgtcagaagtcttagttttataggcagttgtcctgtgatgtcagcggtgcagcgtgcgtgccacctcattgttatctagctaagcggaacatgtgcttcatctgtgggatgctgaaggagatgagtgggcttcggagtgaatgtggcagtttaaaaaataccttcattgtttggacctgcatatttagctgttttggaatgcagttgattcctagagtttcaaata

SEQ ID NO: 339 - DNA, 1421 bp, Homo sapiens
atgaggggtgggcacagcccggccgcggccccagcacacacgggcggacgcaggggcgggggagcgccagccccgcagtgtgttcggagcccagcggctctgagtcgccgccaccagcctggccgccttctgctccacgtaagaaccacatcggtctgttcacccctcccctggaccggcaccgccacagagggtcagagtgttggcacctgtcttccaggtctgttcacccgtcccctggaccggcaccgccacagagggtcagagtgttggcacctgtcttccgggtcagttcacccgtcccctggaccggcaccgccacagagggtcagagtgttggcacctgtcttccgggtcagttcacccgtcccctggaccggcaccggcacagagggtcagagtgttggcacctgtcttccgggtcagttcacccgtcccctggaccggcaccgccacagagggtcaggagtgttggcacctgtcttccgggtcagttcacccgtcccctggaccggcaccgccacagagggtcaggagtgttggcacctgtcttccggatctgttcacccgtcccctggaccggcaccgccacagagggtcagagtgttggcacctgtcttccggatctgttcacccgtcccctggaccggcaccgccacagagggtcagagtgttggcacctgtcttccggatctgttcacccgtcccctggaccggcaccgccacagagggtcagagtgttggcacctgtcttccggatctgttcacccctcccctggatcggcaccggcacagagggtcagagtgttggcacctgtcttccggatctgttcacccgtcccctggaccggcaccgccacagagggtcagagtgttggcacctgtcttccggatctgttcacccctcgcctggaccggcaccggcacagagggtcagagtgttggcacctgtcttccggatctgttcacccctcccctggaccggcaccgccacagagggtcagagtgttggcacctgtcttccggatctgttcacccctcccctggatcggcaccggcacagagggtcagagtgttggcacctgtcttccggatctgttcacccgtcccctggaccggcaccggcacagagggtcagagtgttggcacctgtcttccgggtctgttcacccgtcccctggactggcaccagcacagagggtcgagtgttggcacctgtcttctgggtctccatccctccctttgtttgttgagtgactgcatgttctcatttccttatcatacaattctttgagaggtatcattagctgcgtcttattttattttcaccttcttttctgttacctgtatgtttgaattttcctataagtatttttgtttcatctttgcttttttaaattaaaaaatcagttttaaaattg

SEQ ID NO: 340 - DNA, 4767 bp, Homo sapiens
gcccccgtagttagcgcggtgcttctcttccgctccgggtcggctccgtttccctttccgggcgggcaggcggcggaccccagtgtctttatccctcttttgcacagtcagcttctgcagctctcccgggctagcatggcagcgtggaagagttggacggccctgcggctctgcgccacagttgttgtacttgatatggtcgtctgtaaaggatttgtagaagatttagatgaatcgtttaaagaaaatcgaaatgatgacatttggcttgtagatttttatgcgccatggtgtggccattgtaaaaagctggaaccaatttggaatgaagttggtcttgagatgaaaagcattggttctccagttaaggttggaaagatggatgctacttcctattctagcattgcttcagagtttggagttcgaggttatccaacaattaagctattaaaaggggacttggcatataattatagaggaccacgaacaaaagatgatattattgagtttgctcacagagtatctggggctctaattcggccacttccaagtcaacaaatgtttgaacatatgcagaagagacaccgtgtatttttcgtttatgtaggtggagaatcacctttgaaagagaaatacatagatgctgcttcagaattgattgtatatacatacttcttttctgcctcagaagaagtggttcctgagtatgtgacactaaaagagatgccagctgtgcttgttttcaaagatgaaacttactttgtttatgatgagtatgaagatggtgatctgtcatcatggatcaacagggaaaggtttcagaattaccttgctatggatggcttcctcttgtatgaacttggagacacaggaaagcttgtggctcttgcagttattgatgagaaaaatacatcagttgaacataccagattgaagtcaattattcaggaagttgcaagagattacagagacctcttccatagggattttcagtttggccacatggatggaaatgactacataaataccttgctgatggatgaattgacagtcccaactgtagttgtactgaatacttcaaaccagcaatatttcttgctagatagacagattaagaatgttgaagacatggtccagtttattaataacattttggatggcacagtagaagcccaaggaggtgatagcattttgcagagattgaaaagaatagtatttgatgccaaatctactattgtgtctatattcaagagctcaccactgatgggctgctttctctttggcctgccactgggtgtcatcagtatcatgtgctatggaatctacacagccgacacagatggaggttatatagaagaacgatatgaagtgtctaaaagtgaaaatgaaaaccaagaacagatagaagagagcaaagaacagcaggagcccagcagtggaggatctgtagtgcctacagtgcaggagcccaaggatgtattagaaaagaagaaagattgagacttgatgactataaaatatttgttaggacttcaaattattaaagagtctatttattgaatttagacatttaatcatgatctttacagaaaagaacatgttattcgtattttgctaatatcaactgcatggattaaagtagtccctccatacatggggaagtgtttggagcaaagagatgaacagtttgtctgaaacaaacacagagcactccatcaaaatttacctgatctttgtgattagaacagaacaattctatttgcatgtttctctatctgaatattctgtgacaaaaagttaagattcttgggcagaatatttaaattggtcagtcaggtagaagatacatgtgtgatatagaaaaataatgcctctcctgctgccatccgtttccctcatatattttggacaagatttatatggacaaaattaagtctttaaaatttaggcactttaaggagaactaataactttttccatgtatcaagattatgaggttaaaaataatgtggttttatatagcatagtggttttattttgttagttatttttaaaggagaagaaatgttactttttaactttatactcagttgcattatcataaaattttcatatatgcctagataatggggaaaaaaagtcttgtgattgactttcgcaaaataaacaggatttactgagtagaggtttcagcccattccttggaatactaacaggtatttcatcagtcattgtaggttgggaagggtctctgttaatcctactctgctttagccagaatagcctagtattttatttctattttatatattgagatttcttctaacatttcctttgataaaaatcttctgctttttgaaaagtggtatgtatcatatttttatgtttctggtgtgtgaactttatggtaacttctactctagaatacgtacgtatgcacccacagacacacacagtttattgacacatctattatgtaatgctgtagacctgtccgtgtctgcttcataaggagtaacgactgacattagcatgtccagtgacaagtcacatccggtgtaaaaaaaagagatcagccagttaccttctccattgtcttagttctgtcacccatttcgtcaagtgacctctcatcttctataaactaatacaggaattctttccaaagcaatgtctaaaaactcttttttttaaagtaacagtttggtatgtttattgtagataaattatttttgaggccttcattttagctaagtttagaatttatattaggcaactatgatttgagtggttattcattgagtaattttccactataaagaattttattgaacatttattaaaaaataatgtaatgcatggtcaaaaaatatgtaattcatggtctggacactgacgttgtttagggatttagtcatcaaggacagccctctgttgtttctaatgccgtactaatcaagactgtatggacacttgcatcttaagtactaaggaattactagtgattgttttattttatccatgtactcttttagtatttaataattaaatacctattcttagtgtttgacactccatatttcttttttttggaaatgaaacaaatatgcagtccaaaattcaggaactactagagtgaaatgatattaagtggaaaccagagataaatgctgttaatttaacaagtagattcttctccaaagaatgatgagtgattcttgggaagataaatgttaatgttcccaatagtcaagcttgttttgcagtagtgaaaagcttagatgagtacggatacctcatttgaaactcagcctagtaaggaagtgaaaacttagcagtcagtgacatggggaaatagttatagaaaatgtcactgaattttttcatatttataattagtcatttacatatttttgtcttgttgatcattacctgtaaatgaaagaccttaataggaaaaaaagagtaaagctcagtgtgaatgcaaacatccacaaaatatgatcttcgtttatattctgtgatgttgtttataaatgaatgcctcagttctctgctacccttttcacagctttgtactgtttgccttatattctatttgtgcttttaaagtgtgtctgttgggaaaacaaaatgtgtaggtggtttgtaagtgaataatttttatttcttcttgtattaaaattttgtttttttctctactttgggagatgtttatttacattgtcagactattcacaaaacagattctaaaatttgtttgctcgtatgctgttcccttcaatgtgatatcagagattactatgaatgttagtttcattccgtgaaacattacttccatataaagacagatctcttaataagtgaatctagtggaagaacataggtatcattctaattccatggtaaattttgtcatgattctatatgaataatggggtccttcaggaagttggaatttttgccttctcttttaattgcagtgaagttctctttataacttctaaaattcggaattctagatccttgcttttgcagaatttggtgctcagacaatatttaaggacatttcagcgagacaaagtgcatgtttttatcgagtaccctgtgcaccacattatatctggcaattctttttgtttcattatgtgcatcaatatttttctcagctactattacctgaaacttgtttaacatgtattagacctagaattttcattttctttctcacatagttgcttcctggtatctgatttagaaataacatttaaatgccaagtatctgggggattgaaggaagggtctatatgagcaggtgaattagcagtactgtttttgtttagtggatattgttagtgactttttgtgtgtgttttgctttgggacctttttattttggtgttgcaaaaagtaacatattttcatcattgcttcatacgacatggagttaggacagggaaaaatcattcaacactccttatgcattaaatgatcaaataaaccagtgtaggatattaagactatcaattggtgggattaggcttgacattttatttttataaatatatattttttctgaatgtgtctgagtccaagagtgggcaaaaaataattttctactttggactaatctatagaggtttttgaaagtctgcattactaacttgttgaattcatgatattctgcctatggcacaaattgtaaacctttgtttttctaaaataaagtaattgaaaacctgcaaaaaaaaaaaaaaaaaaaaaaaa

SEQ ID NO: 341 - DNA, 1561 bp, Homo sapiens
gggcttatcccgcctgtcccgccattctcgctagttcgatcggtagcgggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgcccgccgccccccccgccgcccccgccctcagcgccgccgacaccaagcccggcactacgggcagcggcgcagggagcggtggcccgggcggcctcacatcggcggcgcctgccggcggggacaagaaggtcatcgcaacgaaggttttgggaacagtaaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataataaaaaaaaaaaaaaa

SEQ ID NO: 342 - DNA, 2189 bp, Homo sapiens
gccagaggggctaggatgagagacagagggtgtgatggtgggtgctgggagatgtagccgaccttggggctggtggctgggggagtgggtagcctgggaaaggccaggatgtggacggactggtatggcattgagcctgaagtggtccaacttggggttccccagtgcctaggaaagttgtccccttgaatgtcagtgtgaaggtgaaggaggaagcagatgcctgttcatatggaaacaaagacctggctgtgaagaggggaggcggacaccaaagtcctgacacttgggcgggacagaattgatctgtgagagactcatctagttcataccctaggtgaccctgggggtggcatgggggtagattagagatcccagtctggtatcctctggagagtaggagtcccaggagctgaaggtttctggccactgaactttggctaaagcagaggtgtcacagctgctcaagattccctggttaaaaagtgaaagtgaaatagagggtcggggcagtgctttcccagaaggattgctcggcatcctgcccttcccagaagcagctctggtgctgaagagagcactgcctccctgtgtgactgggtgagtccatattctctctttgggtctcaattttgccttccctaatgaaggggtaagattggactaggtaagcatcttacaaccatttgtggtcatgagagctggggtggggaaggattgtcacttgacccccccagctctgtttctaagtgctgaaagagctccaggctatgctacgggaggagaagccagctactgaggaaaagccagctactgagaaaaagcgggagtggtttaccattctcctcccccacctttcaccagagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgaatggaacgctgagcttatcctgtgtggcctgcagccgcttccccaacttcagcatcctctactggctgggcaatggttccttcattgagcacctcccaggccgactgtgggaggggagcaccagccgggaacgtgggagcacaggtacgcagctgtgcaaggccttggtgctggagcagctgacccctgccctgcacagcaccaacttctcctgtgtgctcgtggaccctgaacaggttgtccagcgtcacgtcgtcctggcccagctctgggctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgttttttttttcccccttcactctaatggactgttccagggaagggatgggggcagcagctgcttcggatccacactgtatctgtgtcatccccacatgggtcctcataaaggattattcaatggagaaaaaaaaaaaaaaa

SEQ ID NO: 343 - DNA, 2567 bp, Homo sapiens
ctccggcgcagtgttgggactgtctgggtatcggaaagcaagcctacgttgctcactattacgtataatccttttcttttcaagatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcaggctggtgcagacatctccatgattgggcagtttggtgttggcttttattctgcctacttggtggcagagaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagagaaggaaattagtgatgatgaggcagaggaagagaaaggtgagaaagaagaggaagataaagatgatgaagaaaaacccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcaattttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaaatcttagataagaaggttgagaaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatcttctggcttttcccttgaggatccccagacccactccaaccgcatctatcgcatgatcaagctaggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagtgcccctgtcccacctggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaataaagaatatgccgttttaaaaaaaaaaaaaaaaaaaaaaaaaaaaa

SEQ ID NO: 344 - DNA, 742 bp, Homo sapiens
cgctgctgccgaggaaaaccttgtattattaggcatggtcaaccccaccgtgttcttcgacattgccatcgacggcgagcccttgggccgcgtctccttttagctgtttgcagacaagttcccaaagacagcagaaaattttcgtgctctgagcactggagagaaaggatttagttataagggttcctgctttcacagaattattccagggtttatgtatcagggtcgtgacttcacacgccataatggcactggtggcaagtccatctatggggagaaatttgaagatgagaacttcatcctaaagcatacaggtcctggcatcttgtccatggcaaatgctggacccaacacaaatggttcccagtttttcatctgcactgccaagactgagtggttggatggcaagcatgtggtctttggcaaagtgaaagaaggcatgaatattatggaggccatggagcgctttgggtccaggaatggcaagaccagcaagaagatcaccattgctgactgtggacaactcgaataagtttgacttgtgttttatcttaaccaccagaccattccttctgtagttcaggagaacacccttccaccccatttgctcgcagtatcctagaatctttgtgctcttgctgcagttccatgttttccttgttccctcccatgcctagctggattgcagagttaagtttatgattatgaaataaaaaccaaataacaaaaaaacaagaaaaga

SEQ ID NO: 345 - DNA, 2831 bp, Homo sapiens
agcgccgggagactctgccgtcggtgcgtgcgcggacacgcacccgtcccccttggtctcgccgccagccatggccgccgctacggcctccccccgcagcctccttgttctcctccaggtggtagtgctcgctctggcgcagattagaggtccaccgggagagcggggccccccgggtcccccgggaccgccgggagtgcctggatccgacggcatcgacggtgacaatgggccccctggaaaagctggccctccgggacccaagggcgagcctggcaaagctgggccagatgggccagacgggaagcccgggattgatggtttaactggagccaagggggagcctggccccatggggatccctggagtcaagggccagcccgggcttcctggtcctcctggccttccgggccctggttttgctggacctcctgggcctcctggacctgttggcctccctggtgagattggaatccgaggccccaagggggaccctggaccagatggaccatcggggcccccaggaccccctgggaaacctggtcgcccgggaaccatccagggtctggaaggcagtgcggatttcctgtgtccaaccaactgtccacccggaatgaaaggtcccccagggctgcagggagtgaaggggcatgcgggcaaacgcgggattctgggtgatcctggccaccaggggaagccgggtcccaagggagatgtgggtgcctctggagagcaaggcatccctggaccaccgggtccccagggcatcaggggctacccaggcatggcagggcccaagggagagacgggccctcatggatataaaggcatggtgggcgctatcggtgccactgggccaccgggtgaggaaggtcctaggggaccgccaggccgagctggggagaagggtgacgagggcagcccaggtattcgtggaccccaggggatcacaggcccgaaaggagcaacgggccccccaggcatcaacggcaaggatgggaccccaggcacgcctggcatgaagggcagtgcaggacaggcgggacagcccggaagtccaggccaccagggcctagcgggtgtgccaggccagcctgggacaaaaggaggccctggagaccagggtgagccgggcccgcagggccttcctggattctctggtccccctgggaaagagggagagccagggcctcgaggagaaattggtccccagggcatcatgggacagaagggtgaccaaggcgagaggggtccagtggggcaaccaggccctcagggaaggcagggccctaagggggagcagggcccccccggaattccagggccccaaggcttgccaggcgtcaaaggagacaagggctccccagggaagaccgggccccgcggcaaagtgggtgacccaggggtggccggcctccccggagagaaaggcgagaagggcgagtccggcgagccggggcccaagggacagcaaggagtacgtggagaacccggctaccctggccccagcggggatgcgggcgccccaggggttcagggctaccctggtccccccggccctcgaggactggccgggaaccgaggcgtgccaggacagcccgggagacagggcgtggagggccgggatgccactgaccagcacatcgtggatgtggcgctgaagatgctgcaagagcaactggcagaggtcgccgtgagtgccaagcgggaagccctgggtgcggtgggcatgatgggtcctccaggacctcctgggccccctgggtacccaggcaagcagggcccccatgggcaccctggccctcggggcgttcctggcatcgtgggagccgtgggtcagatcggcaacacggggcccaagggaaaacgtggagagaagggtgatccaggagaagtgggacgggggcaccccgggatgcctgggcccccagggatcccaggactccctggccggcctggccaggcaatcaacggcaaggatggagatcgagggtccccaggggctccaggagaggcaggtcgacctggcctgccaggccccgtggggctgccgggcttctgtgaacctgccgcctgccttggagcttcggcctatgcctctgcccgccttacagagcctggatccatcaaggggccttgagcatcaggcccagacagagcctggcaggcatcctggcgggaaggaccaggtcccctctgggtggacatgcacccatccccagtccaggaaaccatctcccccaggaccttctgtctgggactcaggagtcctaaggaaaaggaattctaaaacatgggggaaggggaggtagagcactgatgggtgaaaaagtgaggccaacacacagggcaagtggtgtcgatggagtcgaagcgctgaaggaatagggcggctttccttccagcgagcatcattcggctgttaccaaaacaaacatcttaatctgcacctttctccactggccatcttgtccttgggtcagtgggacatgggcacctcgggaggcccgggccctgcccagctacagttccacccctcagcttgaggaccaatgactgaggtctatgccagttcctgatcccatctcactctctggacctaccaggtgactgctgctgggtgactcccctgaggcggctatacccttaagccagccccactacttccttccctgcctcccagctcagtatttaaacatcatctcccttctctttctcgcataactccccacccctttctccccgatccacccaggcctttctgtaaataaaagctcccaagttgggtacaaaccaggatattggagttactctatcctggagttaactag

SEQ ID NO: 346 - DNA, 810 bp, Homo sapiens
gcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttgggtaaggaaatggaatactgaagggcccttcactgcctttgctcctcccatgttatgcccagcgtttgatgggtagcagagagaacaaaaaacaccacaaggctatttttccccctgcattctttctgtattgagtatcctttcagtgttattagtgtatgctttgaatgtaaaaattggtcaccctaaggaaaggaattggcatgtgtatgttcccagttcaactcatggagatggcagctgtttaaatgtttttctatgtagtttataaattaaaactgaattgaggactatggaaatgtaggccaaatttgtagtgccaacattttagttctttggaaataa

SEQ ID NO: 347 - DNA, 2383 bp, Homo sapiens
gctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagccgagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggacaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaa

SEQ ID NO: 348 - DNA, 1482 bp, Homo sapiens
ctcccgcccgcccgccctccacggcacccccacccgccccggggtctctttcccccttcctcctcctcctcctccaccccaccttcctcctccgcccgcccgcggggccccccctcaccttcccgcctgcccctattgttccgcccccggcctcccgcccttccccttccagcccattccccttttcccctcagtcgcctcgcgccagcagtttttggctttcaccccccatcagtgaccaaagacttgaccactcaaagtccagctccccagaacactgctcgacatggaaaccagtgtgattgaaggtggattaaatatcactctcaccatccgactacttatgcatggaaaggaagttggcagtatcatcggaaagaaaggagaatcagttaagaagatgcgcgaggagagtggtgcacctatcaacatctcagaagggaattgtcctgagagaattatcacttttgctggacctgctaatgccgtcttcaaaggctttgctatgatcattgacaaactggaagaggacataagcagctctatgaccagtagcacagctgccagtagacccccagtcaccctgaggctggtggtccctgctagtcagtgtggctctctcattggaaaaggtggttgcaagatcaaggaaatacgagagagtacaggggctcaggtctagatggcaggggatatgctacccaactcaactgagcaggccatcactattgctggcatcccacaatccatcattgagtgtgtcaaacagatctgtgtggtcatgttggagtcccccccgaagggcgtgaccatcccgtaccagctcaagccttccagctctccggtcatctttgcaggcggtcaggcctatacccttcaaggacagtttgccattccacagccagatttgaccatgctgcaccagttggcaatgcaacagtctcattttcccatgacgcatggcaacactggattcagtgcaggtttggatacatctgctcagactacttctcatgaacttaccattccaaacgatttgattggctgcataatcgggcgtcaaggcgccaaaataaatgagatccgtcagatgtctggggcacagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagatttatccacaatccctttctgctgttcaccaccacccatgattcatctgtgtagtttctgaacagtcagcgatttcaggttttaaatagtttgtaaattttcagtttctacacactttatcatccactcgtgattttttacttaaagtgttttaattcctttctctgttcagctgttggtgctgagatccatatttagttttataagcttctacctgggatttttttt

SEQ ID NO: 349 - DNA, 1354 bp, Homo sapiens
tttctgcccgtggacaccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacgtatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagactgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccatggtggtggtggatatggtggcagtggggatggctataatggatttggtaatgatggaagcaattttggaggtggtggaagctacaatgattttggcaattacaacaatcagtcttcaaattttggacccatgaagggaggaaattttggaggcagaagctctggcccctatggcggtggaggccaatactttgcaaaaccacgaaaccaagtggctatggcggttccagcagcagcagtagctatggcagtggcagaagattttaattaggaaacaaagcttagcaggagaggagagccagagaagtgacagggaagctacaggttacaatagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaacgtagatttctttttgcaccccatgctgttgattgctaaatgtaatagtctgatcgtgatgctgaataaatgtctttttttt

SEQ ID NO: 350 - DNA, 3129 bp, Homo sapiens
ttgcgttctctttccctctcccaacatggcggcctcagcaaaaaagaagaataagaaggggaagactatctccctaacagactttctggctgaggatgggggtactggtggaggaagcacctatgtttccaaaccagtcagctgggctgatgaaacgatgacctggaaggagatgtttcgacaacttggcacagtaacaatgacgatgtgtatagggtgcctccaattgaccgttccatccttcccactgctccacgggctgctcgggaacccaatatcgaccggagccgtcttcccaaatcgccaccctacactgcttttctaggaaacctaccctatgatgttacagaagagtcaattaaggaattctttcgaggattaaatatcagtgcagtgcgtttaccacgtgaacccagcaatccagagaggttgaaaggttttggttatgctgaatttgaggacctggattccctgctcagtgccctgagtctcaatgaagagtctctaggtaacaggagaattcgagtggatgttgctgatcaagcacaggataaagacagggatgatcgttcttttggccgtgatagaaatcgggattctgacaaaacagatacggactggagggcttgtcctgctacagacagctttgatgactagaagaggtgatgatagctttggagacaagtatcgggatcgttatgattcagaccggtatcgggatgggtatcgggatggcccacgccgggatatggatggatatggtggccgggatcgctatgatgaccaaggcagcagagactatgatagaggctatgattcccggataggcagtggcagaagagcatttggcagcgggtatcgcagggatgatgactacagaggaggcggggaccgctatgaagactgatatgacagacgggatgatcggtcgtggagctccagagatgattactctcgggatgattataggtgtgatgatagacgtcccccccaaagacccaaactgaatctaaagccttggagtactcttaagcaagatgattcctctgctagtacctcccagtccactcgagctgcttctatctttggaggggcaaagcctgttgacacagctgctagagaaagagaagtagaagaacggctacagaaggaacaagagaagttgcagcgtcagctgagtgagccaaaactagaacgacggcctcgggagagacacccaagctggcgaagtgaagaaactcaggaacgggaacggtcaaggacaggaagtgagtcatcgcagactgggacctccaccacatctggcagaaatgcacgaaggagagagagtaagaagtctctagaaaatgaaacactcaataaggaggaagattgccactctccaacttctaaacctcccaaacctgatcagcccctaaaggtaatgccagcccctccaccaaaggagaatgcttgggtgaagcgaagttctaaccctcctgctcgatctcagagctcagacgcagagcagcaatcccctacaagtggtgggggaaaagtagctccagctcaaccatctgaggaaggaccagcaaggcaagatgaaaataaagtagatgggatgaatgtcccaaaaggccaaactgggaactctagccgtggtccaggagacggagggaacaaagaccactggaaggagtcagataggaaagatggcaaaaaggatcaagactccagatctgcacctgagccaaagaaacctgaggaaaatccagcttccaagttcagttctgcaagcaactatgctgctctctcttgatggtgaagatgaaaatgagggagaagattatgccgaatagacctctacatcctgtgcttttctcctagtttctctccaccctggaacattcgagagcaaatcaaaacctctatccagacaagacaaaataaaactcaccatctcctgaagatctttcttacctttttttaaaaacaaaaaatgaaactattttgcatgctgctgcagcctttaaagtattgaagtaactggagaatcgccaatatagccagagagaaagggactacagctttttagaggaaaagttgtggtgcgttatgtcaccacgcagttgccagtgtgattagcgcctaagggtctccatttagcagaaatggtaatgagagtgatataacccctggaacctggttgggcagtaggggagggagggagaaggaaaagtgtgagatttctactttttagtttttatcctattgtggcatatatgaattctcaaacattatctgaataaattttccactcttggaaaggtagatttagcctcaagttgttttagtctccaggaggctgccagcccctcctcttatttaattctgagttttgggggccaccctagagggaattcccttttttttttttttttaccccccaggggggtagttgggagtgagactataggccataaagaatgggactgcattggaccaaaataaatgggaaaatcgtggtttgaaaagaagcttttgggaagtgatgagtcattttgcaccaggtaataggggaaaattgcgtgacctccagcaaacacatgaatggttatttcctggagccggaagcacttgggggtcgtggtaattcccaatgttttctgtgtcctagttttaccctttctaaacactgtcctttttgaaagtttgaatatatccacattgtattgaaaccttgaaactaaaaatttagactcttatcgtcatcttaagttcttcatgatactcttaacctcccaaaaagcagtatctaagtcacatacatgatgtcttgggcattttctctctcagccatggagagctgtgaaaggaagaatcgctgcttttctcaagcaaatcggtttcttgatgtcttttggttctcactccttgcctgttcctgatgctttgaccccttttatagatcagagtgctctagaataatggatggtcttggatggtggataaatagggacagggacagttaaattgggagcctttcttacaaccttgataggcttttttccccccaagtttccttctccactgaaatgccacactaatgcttgttggattcatgaggtggccagaccaacgtgttttttt

SEQ ID NO: 351 - DNA, 3689 bp, Homo sapiens
aagatctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaaggaccagtgtctcccaggaatctgcaggagtctgaagaggaggaagtcccccaggagtcctgggatgaaggttattcgactctctcaattcctcctgaaatgttggcctcgtacaagtcttacagcagcacatttcactcattagaggaacagcaagtctgcatggctgttgacataggcagacatcggtgggatcaagtgaaaaaggaggaccacgaggcaacaggtcccaggctcagcagagagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttaacatggatgaaattgaaaagtaccaagaagtggaagaagaccaagacccatcatgccccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaagcatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcggggagctgttggatgagaaagagcctgaagtcttgcaggagtcactggatagatgctattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacagcatgctgatggaagtggaagagcctgaagtcttgcaggactcactggatatatgttattcgactccgtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagcccttactaagccgagaggtgtcattcctgcaggcaggacctataggcacgtgaagatttgaatgaaagtacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatgtcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttaacctgagtttcataggaggtaatcaccagacaactgcagaatgtagaacactgagcaggacaactgacctgtctccttcacatagtccatatcaccacaaatcacacaacaaaaaggagaagagatattttcggttgaaaaaaagtaaaaagata

SEQ ID NO: 352 - DNA, 1182 bp, Homo sapiens
cccactggctgctctgaaaagccatctttgcattccgcctccgccgcgcgcctcctccgccgccgcggactccggcagctttatcgccagagtccctgaactctcgctttcttttttatcccctgcatcgcgtcaccggcgtgccccaccatgtcagacgcagccgtagacaccagctccgaaatcaccaccgaggacttaaaggagaagaaggaagttgtggaagaggcggaaaatggaagagacgcccctgctaacaggaatgctaatgaggaaaatggggagccggaggctgacaacgaggtagatgaagaagaggaagaaggtggggaggaagaggaggaggaagaaggtgatggtgaggaagaggacggagatgaagatgagggagctgagtcagctacgggcaagcgggcagctgaagatgatgaggatgacgatgtcgatacccagaagcagaagaccgacgaggatgaccagacagcaaaaaaggaaaagttaaactaaaaaaaaaaggccgccgtgacctattcgccctccacttcccgtctcagaatctaaacgtggtcaccttcgagtagaggggcccgcccgcccaccgtgggcagtgccacccgcagatgacacgcgctctccaccacccaacccaaaccatgagaatttgcaacaggggagggaaaaagaaccaaaacttccaaggccctgctttttttttcttaaaagtactttaaaaaggaaacttgtattttttatttacattttatatttttgtacatattgttagggtcggccatttttaatgatctcggatgaccaaaccagccttcggagcgttctctgtcctacttctcactttacttgtggtgtggccatgttcattataatctcaaaggagaaaaaaaaacttgtaaaaaatgcaaaaatgacaacagaaaaaccatcttattccgagcattccagtaacttttttgtgtatgtacttagctgtactataagtagttggtttgtatgagatggttaaaaaggccaaagataaaaggtttcttttttttccttgtctgtgaagttgctgtttatttttttttggcctgtttgatgtatgtgtgaaacaatgttgtccaacaataaacaggaattttattttgctgagctgttctaaaacaaacaaaaacaaaaaaaacc

SEQ ID NO: 353 - DNA, 563 bp, Homo sapiens
cacgcacccactgacctgcgcccactgtctggcactccctagtgagatgaacctggtacctcagatggaaatgcagaaatcacccgtcttctgcgttgctcacgctgggagctgtagaccagagctgttcctattcggccttcttggctccttccctgggctcttttatattgctggcaaaatagtgactccccgtggaacagagttgttgttcagcagaaataatcaagagttgacatcataccagacctcgggactcaacaataaaccagaccagtatggctctatcttcatgaagaacatacacaataattcaggactcacagaagtcgatgagcagaacacagaagactcaacctgaagaaattccatatacgtgctactcctgtgttagtgttttaaataatttatataaaagggcagaaacctagaaattcatatcagaatctatctatatatcacctgtagtttttaaatataatcatgggtatgttttatgtgtatattattattttgtattatagttttagccatcaaacttttaaagaatttaacttacaatt

SEQ ID NO: 354 - DNA, 2116 bp, Homo sapiens
atcagaaccaaattgctgagccagtcacctgtgttccaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatatagacaaagtagccttcacaggatcaacagaggttggcaagttgatcaaagaagctgccgggaaaagcaatctgaagagggtgaccctggagcttggaggaaagagcccttgcattgtgttagctgatgccgacttggacaatgctgttgaatttgcacaccatggggtattctaccaccagggccagtgttgtatagccgcatccaggatttttgtggaagaatcaatttatgatgagtttgttcgaaggagtgttgagcgggctaagaagtatatccttggaaatcctctgaccccaggagtcactcaaggccctcagattgacaaggaacaatatgataaaatacttgacctcattgagagtgggaagaaagaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcaaaagagcaaacaatactttctatggcttatcagcaggagtgtttaccaaagacattgataaagccataacaatctcctctgctctgcaggcaggaacagtgtgggtgaattgctatggcgtggtaagtgcccagtgcccctttggtggattcaagatgtctggaaatggaagagaactgggagagtacggtttccatgaatatacagaggtcaaaacagtcacagtgaaaatctctcagaagaactcataaagaaaatacaagagtggagagaagctcttcaatagctaagcatctccttacagtcactaatatagtagattttaaagacaaaatttttcttttcttgatttttttaaacataagctaaatcatattagtattaatactacccatagaaaacttgacatgtagcttcttctgaaagaattatttgccttctgaaatgtgacccccaagtcctatcctaaataaaaaaagacaaattcggatgtatgatctctctagctttgtcatagttatgtgattttcctttgtagctacttttgcaggataataattttatagaaaaggaacagttgcatttagcttctttcccttagtgactcttgaagtacttaacatacacgttaactgcagagtaaattgctctgttcccagtagttataaagtccttggactgttttgaaaagtttcctaggatgtcatgtctgcttgtcaaaagaaataatccctgtaatatttagctgtaaactgaatataaagcttaataaaaacaaccttgcatgaaaaaaaaaaaaaaaaaaaaa

SEQ ID NO: 355 - DNA, 1235 bp, Homo sapiens
gaatacagaatgtgggcaaactcgcttctgtgccggccgccagaaggtttgctgagggcaatcactccctggtgccgggctccttgaggttatgcactgggacatctagagcctattgtttgaggaatgcagtcttgcaagcctgctctggatcaagccacagactgaaacacccccgaagagcaagcacgtttcttggagcaggctaagtgtgagtgtcatatcttcaatgggatgaagcgggtgcagtacctgaacagatacatccataaacgggaggagaacctgcgcttcgacagcaacgtggaggagttccaggcagttacggaactggggcggcctgtcgcagagaactggaacagccagaagggcatcccggaggagaagcgggacaagatggacgactactgcagatacaattacggggttttttgagagcttcacagtgcagccgcgagtccatcctaaggtgactgtgtatcctgcaaagacccagcccctgcatcaccgcaaccccctggtcggctctgtgagtggtttctatccaggcagcattaaagtcaggtggttccagaatggtcaggaagagaaggctgcggtggtctccataggcctgatccagaatggagattggaccttccagaccctggtgatgctggaaacagttcctcggagtggagaggtttacacctgccaagtggagcatccaagcgtgacgagccctctcacagtggaatggagtacacggactgaatctgcacagagcaagatgctgagtggagtcgggggctttgtgctgggcctgctcttccttgggacagggctgttcatctacttcaggaatcagaaaggacactctggacttcagccaacaggactcctgcgctggactcctgagctgaagtgcacatgaccacattcaaggaagaaccttctgccacagctttgcaggatgaaaagctttcccacttggctcttattcttccacaagagctctctcaggaccaggttgttactcgttcagcaactctgcagaaaatgccctcccttgtggcttcctcagctcctgttcttggcctgaaaccccacagccttgatggcagcgcctcgtcttcaacttttgtgcttccttttacctaaattttcctgcctcccctgggtctgtattccccttgtgccacaaacacattgcattattcaatgtttctcaaacatggagttaaaaattatctggt

SEQ ID NO: 356 - DNA, 1191 bp, Homo sapiens
agtctccagcatcctccacctgtctaccaccgagcatgggcctatatttgaagccttagatctctccagcacagtaagcaccaggagtccatgaagaagatggctcctgccatggaatcccctactctactgtgtgtagccttactgttcttcgctccagatggcgtgttagcagtccctcagaaacctaaggtctccttgaaccctccatggaatagaatatttaaaggagagaatgtgactcttacatgtaatgggaacaatttctttgaagtcagttccaccaaatggttccacaatggcagcctttcagaagagacaaattcaagtttgaatattgtgaatgccaaatttgaagacagtggagaatacaaatgtcagcaccaacaagttaatgagagtgaacctgtgtacctggaagtcttcagtgactggctgctccttcaggcctctgctgaggtggtgatggagggccagcccctcttcctcaggtgccatggttggaggaactgggatgtgtacaaggtgatctattataaggatggtgaagctctcaagtactggtatgagaaccacaacatctccattacaaatgccacagttgaagacagtggaacctactactgtacgggcaaagtgtggcagctggactatgagtctgagcccctcaacattactgtaataaaagctccgcgtgagaagtactggctacaattttttatcccattgttggtggtgattctgtttgctgtggacacaggattatttatctcaactcagcagcaggtcacatttctcttgaagattaagagaaccaggaaaggcttcagacttctgaacccacatcctaagccaaaccccaaaaacaactgatataattactcaagaaatatttgcaacattagtttttttccagcatcagcaattgctactcaattgtcaaacacagcttgcaatatacatagaaacgtctgtgctcaaggatttatagaaatgcttcattaaactgagtgaaactggttaagtggcatgtaatagtaagtgctcaattaacattggttgaataaatgagagaatgaatagattcatttattagcatttgtaaaagagatgttcaatttcaataaaataaatataaaaccatgtaacagaatgcttctgagtaaaaaaaaaaaaaaaaaaaaaaaaaaa

The invention claimed is:

1. A kit comprising:
   primers, nucleic acid probes, and/or antibodies to detect expression or levels of expression of gene products from biomarker genes; and
   a lysate from a monocyte sample of a cancer patient,
   wherein the biomarker genes include Adrenomedulin (ADM), BCL2-associated X protein (BAK), CD68, CTSZ, CXCR4, FKBP5, GPER, Hemoglobin alpha-1 (HBA1), Hemoglobin beta (HBB), LAPTM4A, S100P, and Transketolase (TKT); and
   wherein the kit contains primers, nucleic acid probes, and/or antibodies to detect the expression or levels of expression of gene products of no more than 50 biomarker genes.

2. The kit of claim 1, wherein each of the primers, nucleic acid probes, and/or antibodies is in solution.

* * * * *